United States Patent 11,542,490 (RNAS FOR WOUND HEALING) - sequence listing, part 3

SEQ ID NO: 3502 - RNA, 2506 nt, Artificial Sequence
  mRNA product Design2 comprising derived and/or modified sequence from Homo sapiens__NP_004985.2__HsMMP9 (opt9)
ggggcgcugccuacggagguggcagccaucuccuucucggcaucaagcuuaccaugagccuguggcaaccccucguccucguccuucuuguccucgguugcuguuucgccgcaccccgccaacgacaguccacccucguccucuuccccggagaccuccgcacaaaccuaacugaccgccagcucgccgaagaauaucuuuaccgcuacggcuacacccgcgucgcagaaaugagaggcgaauccaaaucucuggggcccgcccuccuccuccuccaaaaacagcucucccuccccgagaccggagaacuugacuccgccacccucaaagcaaugcgaacaccacgcugcggcgucccagaccucggccgcuuccaaacguucgaaggcgaccuaaaauggcaucaucacaacauuaccuacuggauccaaaacuacuccgaagaccucccccgcgccguaauagacgacgccuucgccagagccuucgcgcucugguccgccgucaccccacuaacauucacccgcgucuacucacgcgacgccgacauagugauucaauucggugucgcugaacacggggacggcuaccccuucgacggaaaagacggccuacuggcccacgcauucccacccggacccggaauccaaggugacgcccacuuugacgacgacgagcuuuggucccuaggaaagggcgucguagucccaacacgcuucggaaacgcagacggcgccgcuugccacuuccccuucauauucgaaggaagguccuacucagcaugcaccaccgacggccgaucagacggccucccguggugcucgaccacagcgaacuacgacacagaugaccgcuucggcuucugccccucagaacgacuauacacccaggacggcaacgccgacggaaaacccugccaauucccauucauauuccagggucagagcuacuccgccuguacgacggacggcagaagcgauggcuaccgcuggugcgcaaccacagcgaacuacgaccgagacaaacuuuucgguuucuguccaacccgcgcagacuccaccguaaugggcggcaacagcgccggagaacuaugcgucuucccauucaccuuccucggaaaagaauacuccacuuguaccucggaaggcagaggcgacggaagacucuggugugcuacaaccucaaacuucgacuccgacaagaaauggggcuucugccccgaucaaggcuacagucuauuccucgucgcagcccacgaguucggacacgcccucgggcucgaccacuccuccguacccgaagcgcuaauguacccaauguacagguuuaccgaaggaccaccccuacacaaagacgacgucaacggaauccgccaccuuuacggcccccgccccgaacccgaaccucguccacccaccacaacaacaccccaacccaccgcaccgccaaccguaugucccacggggcccccuaccguccacccgagcgaaagacccacagcaggcccuaccgguccacccucagcaggacccacaggacccccuacugccggccccucuacagccacuacugucccccuaagcccaguugacgacgcaugcaacguaaacauauuugacgcaaucgccgaaaucggcaaccaacuuuaccuauucaaagacgguaaauacuggcgauucuccgaaggacgcggaagucgcccccagggcccauuccuaaucgcagacaaauggccagcccuaccgagaaaacuagauucagucuucgaagaaagacuaagcaagaaacucuucuucuuuucuggccgacaaguauggguauacacaggagccagcguacuaggccccagaagacucgacaaacuaggccuaggagcagacguugcacaaguaaccggagcucuccguuccggcagaggcaaaaugcuauuguucucuggccgcagacuuuggcgcuucgacgucaaagcucaaaugguagacccccgauccgcauccgaggucgaccgcauguuccccggcguccccuuagacacacacgacguuuuccaguaccgagagaaagccuacuucugccaagaccgcuucuacuggagaguaagcagcagguccgaacucaaccaaguagaccaagucggauacguaacauacgacauccuccaaugcccagaagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3503 - RNA, 1798 nt, Artificial Sequence
  mRNA product Design2 comprising derived and/or modified sequence from Homo sapiens__NP_002418.1__HsMMP13 (opt9)
ggggcgcugccuacggagguggcagccaucuccuucucggcaucaagcuuaccaugcaccccggaguccucgccgcauuccuauuccucuccuggacccacugccgagcccuaccccucccauccggcggagacgaagaugaccucuccgaagaagaccuccaauucgcagaacgcuaccuucgcuccuacuaccacccaaccaaucucgcaggcauccuaaaagaaaacgccgcauccucaaugaccgaacgccuccgagaaaugcaauccuucuucggccucgaagucaccggcaaacucgacgacaacacccucgacguaaugaaaaaaccuagaugcggagucccagacgucggagaauacaacguauucccccguacccugaaauggucaaaaaugaaccucacguacaggaucguaaacuacacccccgacaugacccauagcgaagucgaaaaagccuucaaaaaagccuucaaagucugguccgacgucacuccacuaaacuucacccgucuccacgacggcauagccgacaucaugauauccuucggaaucaaagagcacggcgacuucuaccccuucgacggacccagcggucuccucgcacacgccuuccccccgggccccaacuacggcggagacgcccacuucgaugacgacgagaccuggacauccuccucaaagggcuacaaccucuuccucgucgccgcccacgaauucgggcacucacuuggacucgaccauuccaaagaccccggagcccucauguucccaaucuacacauacaccggcaaaagucacuucaugcuccccgacgacgacguccaaggaauucaaagccucuacggccccggcgaugaagaccccaaccccaaacaucccaaaacacccgacaagugcgacccuucccucagccucgacgcaaucaccucacucagaggcgaaaccaugauauucaaagaccgauucuucuggcgacuccacccgcaacaaguagacgccgaacuauuccuaaccaaauccuucuggccagaacuaccuaaccgaaucgacgccgccuacgaacaccccagccacgaccucaucuucaucuuccgcggcagaaaauucugggcccucaacggcuacgacauccucgaaggcuaccccaaaaaaauaucugaacucggccucccaaaagaagucaaaaaaauauccgccgccguccacuucgaagacaccggcaaaacccuacucuuuagcggcaaccaagucuggcgauacgacgacacgaaccacaucauggacaaagacuacccucgccucaucgaagaagacuucccaggaaucggcgauaaaguagacgcgguuuacgaaaaaaacggcuacaucuacuucuucaacggcccaauacaauucgaauacuccauaugguccaaccgaauagucagagugaugccagcaaauucaauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3504 - RNA, 1450 nt, Artificial Sequence
  mRNA product Design2 comprising derived and/or modified sequence from Homo sapiens__NP_001286.1__HsCCR1 (opt9)
ggggcgcugccuacggagguggcagccaucuccuucucggcaucaagcuuaccauggaaacccccaacacaaccgaagacuacgacaccaccacggaguucgacuacggcgacgccacccccugccaaaagguaaacgaacgagccuucggcgcacaacuucucccaccccuguacucccuaguguucguaauaggccucgucggcaauauccuagucguauuaguccucguccaauacaaacgccucaagaacaugaccucuauauaccuacucaaccuagcaaucuccgaccuccuuuuccuguucacccuccccuucuggaucgacuauaaacucaaagacgauugggucuucggagacgccaugugcaaaauccucuccggcuucuauuauaccggucucuacuccgaaaucuucuucauaauccuccucaccaucgacagauaucucgccauaguccacgccgucuuugcacuccgcgcccgcaccgucaccuucggugucaucaccuccaucauaaucugggccuuagccauccucgccuccaugcccggacucuacuuuuccaaaacccaaugggaguucacccaccauaccugcucccuccacuucccccacgaaucccuacgcgaauggaaacucuuccaagcacuaaaacuaaaccucuuuggccucguccuuccccuccuagucaugaucaucugcuacacaggcaucaucaaaauccuacuucgucgcccuaaugaaaagaaauccaaagccguccgacucaucuucgucaucaugauaaucuuuuuccucuucuggacacccuauaaucucaccauccucaucucugucuuccaagacuuccucuucacacacgaaugcgaacaaucccgccaccuagaccucgccguccaagucaccgaagucaucgcauacacccacugcugcgucaaccccgucauauacgcauucgucggcgaacgcuuccgcaaguaccuccgccaacucuuccaccgacgcgucgcaguccaucucgucaaaugguuacccuuucucucugucgaccgccucgaacgcguauccucaacaucacccuccaccggcgaacaugaacuuucagccggcuucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3505 - RNA, 1018 nt, Artificial Sequence
  mRNA product Design2 comprising derived and/or modified sequence from Homo sapiens__NP_002598.4__HsPDGFA (opt9)
ggggcgcugccuacggagguggcagccaucuccuucucggcaucaagcuuaccaugcgaacccucgccugccuccuccuccucggcugcggcuaccucgcccacguacucgccgaagaagcagaaaucccccgcgaagucaucgaacgccucgcacgcucccaaauccacuccauccgugaccuccaacgacuccuggaaaucgacuccgucggauccgaagacucccuagacaccucccuaagagcccacggcguacacgccacaaaacacguccccgaaaaacgaccccuccccauccgcagaaaacgauccauagaagaagccguccccgccguaugcaaaacacgcacagucaucuacgaaauaccccgcucccaagucgacccaaccuccgccaacuuccuaaucuggccccccugcgucgaagucaaacgcugcaccggcugcugcaacaccuccucagucaaaugccaacccagccgcguccaccaccgcagcgucaaagucgcaaaagucgaauacguacgcaaaaaacccaaacucaaagaaguccaagucagacucgaagaacaccuagaaugcgcaugcgccaccaccagccuaaacccagacuaccgcgaagaagacaccggccgaccccgcgaauccggcaaaaaacgcaaacgcaaaagacuaaaacccaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3506 - RNA, 1108 nt, Artificial Sequence
  mRNA product Design2 comprising derived and/or modified sequence from Homo sapiens__NP_002599.1__HsPDGFB (opt9)
ggggcgcugccuacggagguggcagccaucuccuucucggcaucaagcuuaccaugaaccgcugcugggcccuauuccuaagccuaugcugcuaccuccgccuagucucggccgagggcgaccccauccccgaagaacucuacgaaaugcucagcgaucacucaauccgcuccuucgacgaccuccaacgccuccuccacggcgaccccggcgaagaagacggagccgaacuagaccucaacaugacacgcucacacuccggaggggaacucgaaucccucgcacgcggccgccgcagccuaggcucacuaacaaucgccgaaccagcaaugaucgccgaaugcaaaacaagaacagaagucuucgaaaucucacgccgccuaaucgaccgcaccaacgccaacuuccuagucuggccacccugcgucgaaguccaaagaugcuccggaugcugcaacaacagaaacguccaaugccgccccacccaaguccaacuccgaccaguacaaguaagaaaaauagaaaucguccgcaaaaaacccaucuucaaaaaagcaaccguaacccucgaagaccaccucgcaugcaaaugcgaaaccgucgccgcagcccgccccgucacccgcagccccggcggaagccaagaacaacgagcaaaaacaccccaaaccagagucaccauccgaacaguccgcguacgcagaccccccaaaggaaaacaccgcaaauucaaacacacacacgacaaaaccgcccuaaaagaaacccuaggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3507 - RNA, 1420 nt, Artificial Sequence
  mRNA product Design2 comprising derived and/or modified sequence from Homo sapiens__NP_057289.1__HsPDGFC (opt9)
ggggcgcugccuacggagguggcagccaucuccuucucggcaucaagcuuaccaugucccucuucggccuacuccuccuaacaucugcacucgccggccaacgccaaggcacccaagccgaauccaaccucagcucuaaauuccaauucuccucaaacaaagaacaaaacggcguccaagacccccaacacgaacgcauaaucacagucucaaccaacggcuccauccauucaccccguuucccccacaccuacccccgcaacaccguccuaguauggcgccuaguagcaguagaggaaaacgucuggauccaacucaccuucgacgaacgcuuuggacucgaagauccagaagacgauaucugcaaauacgacuucgucgaaguagaagaaccuuccgacggcacaauccuaggccgauggugcggcuccggcaccgucccaggcaaacaaauauccaaaggcaaccaaauccgcauccgcuucgucuccgacgaauacuuccccuccgaacccggcuucugcauccacuacaacaucgucaugccccaauucaccgaagccgucucccccuccguccucccacccuccgcacucccccuagaccugcucaacaacgccaucaccgccuucucaacccucgaggaccucauacgcuaccuagagcccgaacgcuggcaacucgaccucgaagaccucuaccgcccaacauggcaacuccucggcaaagccuucgucuucggccgcaaaucccgcguagucgaccuaaaccuacuaaccgaagaaguacgccucuacagcugcacaccacgcaacuucucagucuccauccgcgaagaacucaaacgcaccgacaccaucuucuggccaggcugccuccuaguaaaacgcugcggcgggaacugcgccugcugccuccacaacugcaacgaaugccaaugcgucccauccaaagucaccaagaaauaccacgaagugcuacaacuaagaccaaaaaccggcguccgcggacuccacaaaucucucaccgacguagcccuagaacaccacgaagaaugcgacugcgucugccgcggcuccaccggcggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3508 - RNA, 1477 nt, Artificial Sequence
  mRNA product Design2 comprising derived and/or modified sequence from Homo sapiens__NP_149126.1__HsPDGFD (opt9)
ggggcgcugccuacggagguggcagccaucuccuucucggcaucaagcuuaccaugcaccgccucauauuugucuacacacugauaugcgccaacuucuguucaugccgcgacaccuccgccaccccccaaucugccuccauaaaagcccucagaaacgccaaccuacgacgcgacgaccucuaccgacgcgacgaaacaauacaagucaaaggcaacggcuacguacaauccccacgcuuccccaacuccuacccccgcaaccuccuccucaccuggcggcuacacucccaagaaaacacccgcauacagcuuguauucgacaaccaauucggccuagaagaagccgagaacgacaucugccgauacgacuucgucgaagucgaagacaucagcgaaaccuccaccaucaucagaggaagauggugcggccacaaagaaguccccccucgaaucaaaucccgcacaaaccagauaaaaauaacauucaaauccgacgacuacuucgucgccaaacccggcuucaaaaucuacuacucccuccucgaagauuuccaacccgccgccgccuccgaaacaaacugggaauccgucaccuccuccauauccggugucucauacaacuccccaagcgucacagacccaacccucauugcagacgcacuagacaaaaaaaucgccgaauucgacaccgucgaggaccuccuaaaauacuucaaccccgaauccuggcaagaagaccucgaaaacauguaccucgacacaccccgcuacagaggccgcuccuaccacgaccgcaaauccaaggucgaccucgaccgccucaacgacgacgccaaacgcuacagcugcacaccccgcaauuacagugucaacaucagagaggaacuaaaacuagccaacguagucuucuucccacgcugccuacuaguacagcgaugcggcggcaacugcggcugcggcaccgugaacuggcgguccugcaccuguaacuccggcaaaacaguaaaaaaauaucacgaaguccuacaguuugaacccggacacaucaaacgccguggccgcgccaaaacuauggcccucguugacauccaacucgaccaccacgaacgcugcgacugcauaugcucuucccgcccaccccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3509 - RNA, 1060 nt, Artificial Sequence
  mRNA product Design2 comprising derived and/or modified sequence from Homo sapiens__NP_003946.3__HsSOCS3 (opt9)
ggggcgcugccuacggagguggcagccaucuccuucucggcaucaagcuuaccauggucacccauucaaaauuccccgccgccggcaugucccgcccccucgacaccucccuccgccucaaaacauucuccuccaaauccgaauaccaacucgucgucaacgccguccgcaaacuccaagaauccggcuucuacuggucugccgucaccggaggcgaagccaaccuccuacuaucagccgaaccagcuggcaccuuccuaauccgugacuccuccgaccaacgccacuucuucacccucucagucaaaacccaauccggcaccaaaaaccuccgcauccaaugcgaaggcggauccuucucccuacaauccgacccccgcucaacucaaccagucccccgauucgacugcguccucaaacucguccaccacuacaugcccccacccggagcccccuccuuccccuccccacccaccgaacccuccuccgaaguccccgaacaacccuccgcccaaccccuccccggaucaccaccccgccgcgccuacuacaucuacuccggcggcgagaaaaucccccuaguccucucccgcccacucucauccaauguugccacccuacaacaccucugccguaaaaccguaaacggacaccuagacuccuacgaaaaaguuacccaacuacccggccccauccgcgaauuucucgaccaauacgaugcaccccucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3510 - RNA, 865 nt, Artificial Sequence
  mRNA product Design2 comprising derived and/or modified sequence from Homo sapiens__NP_003227.1__HsTGFA (opt9)
ggggcgcugccuacggagguggcagccaucuccuucucggcaucaagcuuaccaugguccccuccgccggccaacuagcccucuucgcccuaggcaucguccucgcagccugucaagcacucgaaaacuccaccuccccccucucagccgacccacccguagccgcagccguagucucccacuucaacgacugccccgacucccacacccaauucugcuuccacggaaccugccgauuccucguccaagaagacaaacccgccugcguaugccacuccggcuacgucggcgcccgcugcgaacacgccgaccuccuagccguaguagccgccucacaaaaaaaacaagccauaaccgcacucguagucgucuccaucgucgcccucgccguccuuauaauaaccugcguccucauccacugcugccaaguacgcaaacacugcgaauggugccgcgcccucaucugcagacacgaaaaacccuccgcacuacucaaaggccgcaccgccugcugccauuccgaaaccguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3511 - RNA, 1555 nt, Artificial Sequence
  mRNA product Design2 comprising derived and/or modified sequence from Homo sapiens__NP_000651.3__HsTGFB1 (opt9)
ggggcgcugccuacggagguggcagccaucuccuucucggcaucaagcuuaccaugccaccauccggccuacgucuccucccucuccuccugccacuccucuggcuauuaguccuaacaccaggccgcccagccgccggccucucaaccugcaaaacuaucgacauggaacuugucaaacgcaaacgaauagaagccauccgcggccaaauccuauccaaacuccgccucgccuccccacccucacaaggcgaaguaccacccggaccccuacccgaagccguccuugcacucuauaacuccacccgcgaccgaguugcuggagaaucagccgaacccgaaccagagccagaagccgacuacuacgccaaagaagucacccgcguacucauggucgaaacacacaacgagauauacgauaaauucaagcaauccacccacuccauauacauguucuucaacaccucagaacuacgagaagccguccccgaacccguccuacuaucacgagccgaacuucgucuccuccgacucaaacucaaggucgaacaacacgucgaacucuaccaaaaauauucaaacaacucauggcgcuaccuaucaaaccgccuacuagcaccaucagacucacccgaauggcuaucauucgacgucaccggagucguccgccaauggcuaucacgaggaggcgaaaucgaaggcuucagacucucagcccacugcuccugcgacucccgagacaacacccuccaagucgacaucaacggcuucaccaccggccgacgcggagaccucgccacaauacacggaaugaaccgacccuuccuacuccucauggcaacaccacucgaacgcgcccaacaccuccaaucuucccgccaccgccgagcccuggacaccaacuacugcuucuccuccacugagaaaaauugcugcgugagacaacucuacaucgacuuccgcaaagaccucggcuggaaauggauccacgaaccaaaaggcuaccacgcaaacuucugccucggccccugcccauacauauggucccuagacacccaauacuccaaaguucuagcccuauacaaccaacacaaccccggcgccuccgcggcucccugcugcguuccccaagcccucgaaccccucccaauagucuacuacgucggccgcaaaccaaaagucgaacaacucuccaacaugaucguccgauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3512 - RNA, 1627 nt, Artificial Sequence
  mRNA product Design2 comprising derived and/or modified sequence from Homo sapiens__NP_003229.1__HsTGFB2 (opt9)
ggggcgcugccuacggagguggcagccaucuccuucucggcaucaagcuuaccaugcacuacugcguacucucagccuuccucauccuccaccucgucaccgucgcacuaucacuaucuaccugcagcacacucgauauggaccaauucaugcgcaaacgcauagaagcuauccguggccaaauccuauccaaacucaagcucaccagcccacccgaagacuauccugaacccgaagaagucccacccgaaguaaucuccaucuacaacuccacacgcgaccuccuacaagaaaaagccucccgacgcgcagccgccugcgaacgagagcgcuccgacgaagaauacuacgccaaagaaguauacaagauagacaugccacccuucuucccuuccgaaaacgccauacccccaaccuucuaccgcccauacuuccgcaucguccgcuucgacgucucugcuauggagaaaaaugcauccaaccucgucaaagccgaguuccgcguauuccgccuacaaaaccccaaagcgcgcgucccugaacaacgcaucgaacucuaccagauccucaaauccaaagaucuuaccucgcccacacaacgcuacaucgacuccaaagucguaaagacccgcgccgaaggagaauggcucuccuucgacguaaccgacgccguccacgaauggcuacaccacaaagaccgcaaccucggcuucaaaaucucccuacacugccccugcugcaccuucguccccuccaacaauuacaucauccccaauaaauccgaagaacucgaagccagauucgccggcaucgacggcaccucaaccuacacauccggcgaccagaaaaccaucaaaucaacccgcaagaaaaacuccggcaaaaccccacaucuccuccucaugcuucucccuucauaccgucucgaaucucaacaaaccaaccgacgcaagaaacgcgcccucgacgccgccuacuguuuccgcaacguccaagacaacugcugccuacgaccccucuacauagacuucaaacgcgaccucggcuggaaauggauccacgaacccaaaggcuacaacgcuaacuucugcgcgggcgccugccccuaccuaugguccuccgacacccaacacucacgcguccucucccucuacaacaccaucaauccugaagccuccgccucacccugcugcgucucccaagaccucgaaccacucaccauacuauacuacaucggcaaaacgccuaaaauagaacaacuaucuaacaugaucgucaaauccuguaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3513 - RNA, 1621 nt, Artificial Sequence
  mRNA product Design2 comprising derived and/or modified sequence from Homo sapiens__NP_003230.1__HsTGFB3 (opt9)
ggggcgcugccuacggagguggcagccaucuccuucucggcaucaagcuuaccaugaaaaugcaccuccaacgcgcccuagucguacucgcacuacucaacuuugccaccguaucacuuucacucuccacaugcaccacacucgacuuuggccacaucaaaaagaaacgagucgaagcuauacgaggccaaauccuaucaaaacuacgccucacauccccacccgaacccacaguaaugacccacguccccuaccaaguacucgcccuauacaacuccacccgcgaacuccuagaagaaaugcacggagaaagagaagaaggaugcacccaggaaaacaccgaaucagaauacuacgccaaagaaauacacaaauucgacaugauccaaggccucgccgaacacaacgaauuagccgucugccccaaagguaucacuagcaaaguauuccgauucaacguuuccucggucgagaaaaaccgcaccaaccuauuccgagccgaguuccguguccuccgcguccccaacccaagcucaaaacgcaacgaacaacgcaucgaacuuuuccaaauacuaagacccgacgaacacaucgccaaacaacgcuacauaggcggcaaaaaccucccaacccgcggcaccgcagaauggcucucuuucgacgucaccgacaccguacgugaauggcuacucagacgcgaauccaaccuaggucuagaaaucucaauacacugccccugccacaccuuccaaccaaacggagacauccucgaaaacauccacgaagucauggaaaucaaauucaaaggagucgacaaugaagacgaccacggacgaggcgaccucggacgacucaaaaagcaaaaagaccaccacaacccccaccucauccuaaugaugaucccaccccaccgccucgacaaccccggacaaggcggccaacgcaagaaacgcgcccucgacaccaacuacugcuuccgcaaccuagaagaaaacugcugcguacgcccccucuacaucgacuuccgacaagaccuaggcuggaaauggguccacgaacccaaaggauacuacgcaaauuucugcagcggaccaugcccauaccuacgguccgccgacacaacccacuccacaguccuaggacuuuauaacacccuaaacccagaagccuccgccucccccugcugugucccccaagaccuugaaccucucaccauccuuuacuacgucggcagaacccccaaagucgaacaacuauccaacauggucgucaaauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3514 - RNA, 1768 nt, Artificial Sequence
  mRNA product Design2 comprising derived and/or modified sequence from Homo sapiens__NP_001057.1__HsTNFRSF1B (opt9)
ggggcgcugccuacggagguggcagccaucuccuucucggcaucaagcuuaccauggcacccguugcagucugggcagcccuugccgucggccucgaacucugggccgcugcccacgcccuccccgcccaaguugccuucacuccuuacgccccagaaccaggcuccacaugccgacuccgagaauacuaugaccaaacagcccaaaugugcugcuccaagugcucccccggccaacacgccaaagucuucuguaccaaaaccucugacaccgucugcgacuccugcgaagacuccacuuacacccaacuauggaacuggguacccgaaugccucuccugcggcuccagaugcucauccgaccaagucgaaacccaagcaugcacacgcgaacaaaaccgaaucugcacaugcaggcccggaugguacugcgcacucuccaaacaagaaggcugccgccucugcgcaccccuccgaaaaugccgaccaggcuucggcgucgcccgcccaggaacagaaaccuccgacguagucugcaaacccugcgccccuggcacuuucuccaacacaaccagcucaaccgacauaugccgcccacaccaaaucugcaacgucguugcaauacccggcaacgcauccauggacgccgucugcaccuccacaucgcccacccgauccauggcacccggcgccguccaccucccccaaccugucucaacccgaucacaacacacacaacccacccccgaacccucaaccgccccauccaccucauuccuucuacccaugggccccuccccacccgccgaaggcuccaccggagacuucgcccucccagucggccuaaucgucggcgucaccgcccuaggccugcucaucaucggagucgucaacugcguaaucaugacccaagucaaaaagaagccccuaugucuccaaagagaagcaaaaguaccucaccuccccgccgacaaagcccgcggcacacaaggccccgaacaacaacaccuccuaaucaccgccccaucauccuccucaucaagccucgaaucaucagcaucagcucucgaccgccgcgccccaaccagaaaccaaccccaggccccaggcguagaagccuccggagccggagaagcccgagccucaacaggcuccuccgacagcucucccggcggccacggcacacaaguaaacguaaccugcaucgucaauguaugcucgucauccgaccauuccucccaaugcucaagccaagccucaucaaccaugggcgacaccgacucaagcccaucugaaucccccaaagacgaacaaguacccuucaguaaagaagaaugugccuuccgaucccaauuagaaacccccgaaacacuccuaggauccaccgaagaaaaacccuuaccccucggugucccagacgccggcaugaaacccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3515 - RNA, 895 nt, Artificial Sequence
  mRNA product Design2 comprising derived and/or modified sequence from Homo sapiens__NP_002623.2__HsPGF (opt9)
ggggcgcugccuacggagguggcagccaucuccuucucggcaucaagcuuaccaugccggucaugcgcuuguucccgugcuuucuacagcucuuggcagggcucgcacucccagccgugcccccgcaacagugggcguuaucggccgggaacgggagcucggaaguggaagugguaccguuccaggaagugugggggcgcucguacugucgcgcgcuagagcgccuggucgaugucgugagugaguacccgagcgaggucgagcacauguucucgcccucaugcgugagcuugcucaggugcacgggcuguugcggggacgagaaccugcacugugucccggucgagaccgcgaacgugaccaugcaauugcucaagaucaggagcggggacaggcccucguacguggaauugaccuucagccagcacguacgcugugaaugucgcccacucagggaaaagaugaagccagaacgcaggcgaccgaaagggcgcgggaaaaggcgcagagaaaagcaaaggcccacagacugucacuuaugcggggacgcggucccgaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3516 - RNA, 1621 nt, Artificial Sequence
  mRNA product Design2 comprising derived and/or modified sequence from Homo sapiens__NP_001020537.2__HsVEGFA (opt9)
ggggcgcugccuacggagguggcagccaucuccuucucggcaucaagcuuaccaugacagaccgccagacagacaccgcgccaucgcccucguaccaccuccugcccgggagaaggcgcacggucgacgccgcagccucgcgaggacaagggcccgagccagcgccaggaggcgggguagagggcgugggagcgcgaggggucgcgcucaaacucuucguccagcuucugggcugcagcagguucgggggcgcaguagugcgcgcaggcgaagccgagcccucaggcgcggccaggagcgcaagcucaggcagagaggaaccccagcccgaggagggggaagaagaagaggaaaaagaagaagaaagggguccacaauggcgccugggcgcgcgcaagccaggaaguuggaccggagaagcagcagugugcgcggacucugcaccagccgcgcgagcgccccaggcauuggccagagcaucaggcagaggaggacgaguggcaagaagaggagccgaggaaucaggaccgccccauagcccaagcaggcgagggagugcgagcagagccggaccagggcgcgcaagcgagacaaugaacuuccuccugagcuggguacacuggucgcuagcacuguugcucuaccuccaucacgcaaaauggagccaggccgcgccaauggccgagggaggaggacaaaaccaccacgagguagugaaauucauggacgucuaccaaaggagcuauugccaccccauagaaacgcuaguggacauauuccaggaauauccagacgaaauagaguacauauucaaaccaagcugcgugccgcucaugaggugcggcggaugcuguaacgaugaagggcuagagugcguacccacggaagagagcaacaucaccaugcagaucaugaggauaaaaccgcaccagggccagcacauaggagagaugucauuccugcaacacaacaagugcgagugccggcccaagaaagaccgagcaagacaggaaaagaaaucaguaaggggaaagggcaagggacagaaaagaaaaagaaagaagaguagguacaagagcuggaguguauacguaggggcgagaugcugccugaugccauggagccuaccgggaccgcacccaugcggacccugcagcgaacgcaggaaacaccuguucguccaggacccacaaacaugcaaguguucaugcaagaacacagacucgcgcuguaaagcacgccaacucgagcuuaacgaaaggacaugccgcugcgacaaacccaggagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3517 - RNA, 1081 nt, Artificial Sequence
  mRNA product Design2 comprising derived and/or modified sequence from Homo sapiens__NP_001165094.1__HsVEGFA (opt9)
ggggcgcugccuacggagguggcagccaucuccuucucggcaucaagcuuaccaugaacuuccuacucagcuggguccacuggucacucgcccuccuccucuaccuccaccacgccaaauggucccaagccgcccccauggccgaaggcggcggccaaaaccaccacgaaguaguaaaauucauggacguauaccaacgcagcuacugccaccccaucgaaacccuaguagacaucuuccaagaauaccccgacgaaaucgaauacauauucaaacccuccugcgucccacucaugcgcugcggcggcugcugcaacgacgaaggccucgaaugcguccccacagaagaaagcaacaucacaaugcagauaaugcgaaucaaaccccaccaaggccagcacaucggcgaaaugucauuccuccaacacaacaaaugcgaaugccgaccaaaaaaagaccgcgcaagacaagaaaaaaaauccgucagaggcaaaggcaaaggccaaaaacgaaaacgcaaaaaaucccgcuacaaaagcuggucagucuacguaggcgcccgcugcugccucaugccauggucccuccccggcccccaccccugcgggcccugcagcgaacgccgcaaacaccucuucguccaagacccacaaaccugcaaaugcuccugcaaaaacaccgacucccgcugcaaagcccgccaacucgaacuaaacgaacgcaccugccgcugcgacaaaccccgaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3518 - RNA, 1006 nt, Artificial Sequence
  mRNA product Design2 comprising derived and/or modified sequence from Homo sapiens__NP_003368.1__HsVEGFB (opt9)
ggggcgcugccuacggagguggcagccaucuccuucucggcaucaagcuuaccauguccccccuccuccgccgacuccuacuagccgcccuccuacaacucgcccccgcacaagcccccgucucccaacccgacgcccccggccaccaacgcaaagucguauccuggauagacguauacacccgcgccaccugccaaccacgagaagucguagucccacucacagucgaacucaugggcaccgucgcaaaacaacucguaccaucaugcguaaccguccaacgaugcggcggcugcugccccgacgacggccuagaaugcguccccaccggccaacaccaagucagaaugcaaauccucaugauccgcuaccccuccucccaacucggcgaaaugucacucgaagaacacucccaaugcgaaugccgccccaaaaaaaaagacucagccguaaaacccgaccgcgccgccacaccacaccaccgaccccaaccccgcucagucccaggcugggacuccgcccccggcgcacccucccccgccgacaucacccaccccacccccgcacccggccccuccgcacacgccgccccauccaccaccuccgcccucacccccggccccgccgccgccgccgccgacgccgccgccagcuccgucgcaaaaggcggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3519 - RNA, 1642 nt, Artificial Sequence
  mRNA product Design2 comprising derived and/or modified sequence from Homo sapiens__NP_005420.1__HsVEGFC (opt9)
ggggcgcugccuacggagguggcagccaucuccuucucggcaucaagcuuaccaugcaccuccucggauucuucuccgucgccugcucccuacucgccgccgcacuccuccccggcccacgcgaagcaccagcagccgccgccgcauucgaaucaggccucgaccuauccgacgccgaaccagacgccggcgaagccaccgccuaugcaagcaaagaccucgaagaacaacuacgauccguaucauccguggacgaacuaaugaccguccucuacccagaauacuggaaaauguacaaaugccaacuccgaaaaggcggauggcaacauaaccgcgaacaagccaaccucaacagccgaaccgaagaaacaaucaaauucgccgccgcccacuacaacacggaaauacuaaaauccaucgacaacgaauggagaaaaacacaaugcaugccccgugaagucugcaucgacgucggcaaagaauuuggcgucgccaccaacacauucuucaaaccacccugcgucucaguauaccgaugcggcgggugcugcaacuccgaaggccuacaaugcaugaacaccuccaccucauaccucucaaaaacccucuucgaaauaacaguuccacucagccaaggccccaaacccgucacgauauccuucgcaaaccauacuucaugccgcugcaugucaaaacuugacguauaccgccaaguccacuccaucauccgaagaucacuacccgccacccuaccccaaugucaagccgccaacaaaaccugccccaccaacuacauguggaacaaccacauuugccgcugccuagcccaagaagacuucauguucucaucggacgccggcgacgacucaaccgacggcuuccacgacauaugcggccccaacaaagaacuagacgaagaaacaugccaaugcgucugccgcgccggccuccgacccgcauccugcggaccccacaaagaacuggaccgcaacucaugccaaugcgucugcaaaaacaaacucuuccccucccaaugcggcgcaaaccgcgaguucgacgaaaauaccugccaaugcgucugcaagcgaaccugcccacgcaaccaaccccucaaccccggaaagugcgccugcgaaugcaccgaaagcccacaaaaaugccuucucaaaggaaagaaauuccaccaccaaaccugcucaugcuaccgccgccccugcaccaaccgccaaaaagccugcgaacccggcuucucauacuccgaagaaguaugccgcugcguuccaagcuacuggaaacgcccccaaauguccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3520 - RNA, 1447 nt, Artificial Sequence
  mRNA product Design2 comprising derived and/or modified sequence from Homo sapiens__NP_004460.1__HsVEGFD (opt9)
ggggcgcugccuacggagguggcagccaucuccuucucggcaucaagcuuaccauguaccgagaauggguagucgucaacgucuucaugaugcucuacguccaacugguccaagguucauccaacgaacauggccccgucaaacgcuccucccagagcacccucgagcgcuccgaacaacaaauccgcgcugccuccucucuagaagaacuucuccgaaucacccacucugaagacuggaaauuauggcgaugccgccuacgucucaagagcuucaccucaauggacucccgauccgcaucccaccgcucuacacgauucgccgccaccuucuacgacaucgaaacccucaaagucauagacgaagaauggcaacgcacccaaugcuccccaagggaaaccugcgucgaaguagccuccgaacucggcaaauccaccaacacauucuucaaaccucccugcgucaacgucuuccgcugcggcggcugcugcaacgaagaaucccucaucugcaugaacacauccaccuccuacauauccaaacaacuauucgaaauuucugucccccucaccucgguccccgaacucguccccgucaaaguagccaaccacaccggcugcaaaugccugcccaccgccccacgacaccccuauuccaucauccgacgcuccauacagauucccgaagaagaccgaugcucccacucaaagaaacucugccccauagacaugcuaugggacucaaacaaaugcaaaugcguccuccaagaagaaaacccacucgccggcacugaagaccacucgcaccuccaagaacccgcccucugcggaccccacaugauguucgacgaagaccgcugcgaaugcgucugcaaaaccccaugccccaaagaccucauccaacaccccaaaaacugcucaugcuucgaaugcaaagaaucccucgagaccugcugccaaaaacacaaacucuuccaccccgauaccugcuccugcgaagaccgcugccccuuccacacacgcccaugcgccuccggcaaaaccgcaugcgcaaaacacugccguuucccaaaagaaaaacgcgccgcccaaggcccccacucccgcaaaaaccccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3521 - RNA, 1012 nt, Artificial Sequence
  mRNA product Design2 comprising derived and/or modified sequence from Homo sapiens__NP_061986.1__HsFGF21 (opt11)
ggggcgcugccuacggagguggcagccaucuccuucucggcaucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3522 - RNA, 1792 nt, Artificial Sequence
  mRNA product Design2 comprising derived and/or modified sequence from Homo sapiens__NP_002412.1__HsMMP1 (opt11)
ggggcgcugccuacggagguggcagccaucuccuucucggcaucaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3523 - RNA, 1552 nt, Artificial Sequence
  mRNA product Design2 comprising derived and/or modified sequence from Homo sapiens__NP_002412.1__HsMMP1(1-19,100-469) (opt11)
ggggcgcugccuacggagguggcagccaucuccuucucggcaucaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3524 - RNA, 3739 nt, Artificial Sequence
  mRNA product Design2 comprising derived and/or modified sequence from Clostridium histolyticum__BAA77453.1__ColG (opt11)
ggggcgcugccuacggagguggcagccaucuccuucucggcaucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3525 - RNA, 3463 nt, Artificial Sequence
  mRNA product Design2 comprising derived and/or modified sequence from Clostridium histolyticum__BAA77453.1__HsALB(1-18)_ColG(111-1118) (opt11)
ggggcgcugccuacggagguggcagccaucuccuucucggcaucaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3526 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt11)
ggggcgcugccuacggagguggcagccaucuccuucucggcaucaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3527 - RNA, 3487 nt, Artificial Sequence; identical to SEQ ID NO: 2699
  mRNA product Design2 comprising derived and/or modified sequence from Clostridium histolyticum__BAA34542.1__ColH (opt11)

SEQ ID NO: 3528 - RNA, 3448 nt, Artificial Sequence
  mRNA product Design2 comprising derived and/or modified sequence from Clostridium histolyticum__BAA34542.1__ColH (opt11)
ggggcgcugccuacggagguggcagccaucuccuucucggcaucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3529 - RNA, 3382 nt, Artificial Sequence
  mRNA product Design2 comprising derived and/or modified sequence from Clostridium histolyticum__BAA34542.1__HsALB(1-18)_ColH(41-1021) (opt11)
ggggcgcugccuacggagguggcagccaucuccuucucggcaucaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3530 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt11)
ggggcgcugccuacggagguggcagccaucuccuucucggcaucaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3531 - RNA, 958 nt, Artificial Sequence
  mRNA product Design2 comprising derived and/or modified sequence from Homo sapiens__NP_001133.1__HsAMELX (opt11)
ggggcgcugccuacggagguggcagccaucuccuucucggcaucaagcuuaccaugggcaccuggauacuauucgccugccuccucggcgccgccuucgccaugccccuacccccccaccccggccaccccggcuacaucaacuucucauacgaaguccucaccccccucaaaugguaccaaucaauccgcccccccuaccccuccuacggcuacgaacccaugggaggcuggcuccaccaccaaaucauccccguccucucccaacaacacccccccacccacacccuccaaccccaccaccacauccccgucguccccgcccaacaacccgucaucccccaacaacccaugaugcccguccccggccaacacucaaugacccccauccaacaccaccaacccaaccuccccccccccgcccaacaacccuaccaaccccaacccguccaaccccaaccacaccaaccaaugcaaccccaaccccccguccaccccaugcaaccccuccccccccaacccccccuaccccccauguuccccaugcaaccccucccccccaugcuccccgaccucacccucgaagccuggcccuccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3532 - RNA, 517 nt, Artificial Sequence
  mRNA product Design2 comprising derived and/or modified sequence from Homo sapiens__NP_001133.1__HsAMELX-TRAP (opt11)
ggggcgcugccuacggagguggcagccaucuccuucucggcaucaagcuuaccaugccccuccccccccaccccggccaccccggcuacaucaacuucuccuacgaaguccucaccccccucaaaugguaccaauccauccgcccccccuaccccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3533 - RNA, 550 nt, Artificial Sequence
  mRNA product Design2 comprising derived and/or modified sequence from Homo sapiens__NP_001133.1__HsAMELX-LRAP (opt11)
ggggcgcugccuacggagguggcagccaucuccuucucggcaucaagcuuaccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3534 - RNA, 589 nt, Artificial Sequence
  mRNA product Design2 comprising derived and/or modified sequence from Homo sapiens__NP_001133.1__HLA-A2-SP_HsAMELX(17-60) (opt11)
ggggcgcugccuacggagguggcagccaucuccuucucggcaucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccauccgcccccccuaccccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3535 - RNA, 622 nt, Artificial Sequence
  mRNA product Design2 comprising derived and/or modified sequence from Homo sapiens__NP_001133.1__HLA-A2-SP_HsAMELX(17-47,168-191) (opt11)
ggggcgcugccuacggagguggcagccaucuccuucucggcaucaagcuuaccauggccgucauggccccccgcacccucguccuacuccucuccggcgcccucgcccucacccaaaccugggccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3536 - RNA, 961 nt, Artificial Sequence
  mRNA product Design2 comprising derived and/or modified sequence from Homo sapiens__NP_001134.1__HsAMELY (opt11)
ggggcgcugccuacggagguggcagccaucuccuucucggcaucaagcuuaccaugggcaccuggauccucuucgccugccucgucggcgccgccuucgcaaugccccuccccccccaccccggccaccccggcuacaucaacuucuccuacgaaguccucaccccacucaaaugguaccaauccaugauccgcccacccuacucauccuacggcuacgaaccaaugggcggcuggcuccaccaccaaaucauccccgucguaucccaacaacacccccucacccacacccuccaaucccaccaccacauccccgucguccccgcacaacaaccccgcguccgccaacaagcccucaugcccguccccggccaacaauccaugacccccacccaacaccaccaacccaaccucccccuccccgcccaacaacccuuccaaccccaacccguccaaccccaaccccaccaacccaugcaaccccaacccccaguccaacccaugcaaccccuccucccccaacccccccucccccccauguucccacuccgaccccucccccccauccuacccgaccuccaccuugaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3537 - RNA, 520 nt, Artificial Sequence
  mRNA product Design2 comprising derived and/or modified sequence from Homo sapiens__NP_001134.1__HsAMELY-TRAP (opt11)
ggggcgcugccuacggagguggcagccaucuccuucucggcaucaagcuuaccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3538 - RNA, 553 nt, Artificial Sequence
  mRNA product Design2 comprising derived and/or modified sequence from Homo sapiens__NP_001134.1__HsAMELY-LRAP (opt11)
ggggcgcugccuacggagguggcagccaucuccuucucggcaucaagcuuaccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3539 - RNA, 592 nt, Artificial Sequence
  mRNA product Design2 comprising derived and/or modified sequence from Homo sapiens__NP_001134.1__HLA-A2-SP_HsAMELY(17-61) (opt11)
ggggcgcugccuacggagguggcagccaucuccuucucggcaucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3540 - RNA, 625 nt, Artificial Sequence
  mRNA product Design2 comprising derived and/or modified sequence from Homo sapiens__NP_001134.1__HLA-A2-SP_HsAMELY(17-48,169-192) (opt11)
ggggcgcugccuacggagguggcagccaucuccuucucggcaucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3541 - RNA, 952 nt, Artificial Sequence
  mRNA product Design2 comprising derived and/or modified sequence from Sus scrofa__NP_999071.1__SsAMELX-001-1 (opt11)
ggggcgcugccuacggagguggcagccaucuccuucucggcaucaagcuuaccaugggcaccuggauccucuucgccugucuccucggcgccgccuucuccaugccccuccccccccaccccggccaccccggcuacaucaacuucuccuacgaaguccucaccccccucaaaugguaccaaaacaugauccgacaccccuacaccuccuacggcuacgaacccaugggcggcuggcuccaccaccaaaucauccccgucgucucccaacaaaccccccaaucccacgcccuucaaccccaccaccacauccccaugguccccgcccaacaacccggcauaccccaacaacccaugaugccccucccuggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuccucccccaaccaccccuaccccccauguucuccaugcaaucccuccuccccgaccucccccucgaagccuggcccgccaccgacaaaacaaaacgugaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3542 - RNA, 520 nt, Artificial Sequence
  mRNA product Design2 comprising derived and/or modified sequence from Sus scrofa__NP_999071.1__SsAMELX-TRAP (opt11)
ggggcgcugccuacggagguggcagccaucuccuucucggcaucaagcuuaccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3543 - RNA, 553 nt, Artificial Sequence
  mRNA product Design2 comprising derived and/or modified sequence from Sus scrofa__NP_999071.1__SsAMELX-LRAP (opt11)
ggggcgcugccuacggagguggcagccaucuccuucucggcaucaagcuuaccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3544 - RNA, 592 nt, Artificial Sequence
  mRNA product Design2 comprising derived and/or modified sequence from Sus scrofa__NP_999071.1__HLA-A2-SP_SsAMEL(17-61) (opt11)
ggggcgcugccuacggagguggcagccaucuccuucucggcaucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3545 - RNA, 625 nt, Artificial Sequence
  mRNA product Design2 comprising derived and/or modified sequence from Sus scrofa__NP_999071.1__HLA-A2-SP_SsAMEL(17-49,167-189) (opt11)
ggggcgcugccuacggagguggcagccaucuccuucucggcaucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3546 - RNA, 916 nt, Artificial Sequence
  mRNA product Design2 comprising derived and/or modified sequence from Sus scrofa__P45561-2__SsAMELX-001-2 (opt11)
ggggcgcugccuacggagguggcagccaucuccuucucggcaucaagcuuaccaugggcaccuggauccucuucgccugccuccucggcgccgccuucuccaugccccuccccccccaccccggccaccccggauacaucaacuucuccuacauccgacaccccuacaccuccuacggcuacgaacccaugggcggcuggcuccaccaccaaaucauccccgucgucucccaacaaaccccccaaucccacgcccuccaaccacaccaccacauccccaugguccccgcccaacaacccggcaucccccaacaacccaugaugccccuccccggccaacacuccaugacccccacccaacaccaccaacccaaccucccccuucccgcccaacaacccuuccaaccccaacccguccaaccccaaccccaccaaccccuacaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3547 - RNA, 952 nt, Artificial Sequence
  mRNA product Design2 comprising derived and/or modified sequence from Sus scrofa__NP_998965.1__SsAMELX-001-3 (opt11)
ggggcgcugccuacggagguggcagccaucuccuucucggcaucaagcuuaccaugggcaccuggaucuucuucgccugccuccucggcgccucccucgccaugccccucccaccccaccccggccaccccggcuacaucaacuucuccuacgaaguccucacaccccucaaaugguaccaaaacaugauccgccaccccuacaccuccuacggcuacgaacccaugggcggcuggcuccaccaccaaaucauccccgucgucucucaacaaacaccccaaucccacgcccuccaaccccaccaccacauccccaugguccccgcccaacaacccggcauaccccaacaacccaugaugccccuccccggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuacucccccaaccaccccuaccacccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3548 - RNA, 601 nt, Artificial Sequence
  mRNA product Design2 comprising derived and/or modified sequence from Sus scrofa__K7GPB2__SsAMELX-002 (opt11)
ggggcgcugccuacggagguggcagccaucuccuucucggcaucaagcuuaccaugggcaccuggauccucuucgccugccuccucggcgccgccuucuccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3549 - RNA, 994 nt, Artificial Sequence
  mRNA product Design2 comprising derived and/or modified sequence from Sus scrofa__K7GLD0__SsAMELX-003 (opt11)
ggggcgcugccuacggagguggcagccaucuccuucucggcaucaagcuuaccaugggcaccuggauccucuucgccugccuccucggagccgccuucuccaugccccuacccccccaccccggccaccccggcuacaucaacuucuccuacgaagaccuuuaccucgaagccauccgcaucgaccgcaccgccuucguccucaccccccuaaaaugguaccaaaacaugauccgccaccccuacaccuccuacggcuacgaacccaugggcggcuggcuccaccaccaaaucauccccgucgucucccaacaaaccccccaaucccacgcccuccaaccccaccaccacauccccaugguccccgcccaacaacccggcaucccccaacaacccaugaugccccuccccggccaacacuccaugacccccacccaacaccaccaacccaaccucccccuccccgcccaacaacccuuccaaccccaacccguacaaccccagccccaccaaccccuucaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3550 - RNA, 880 nt, Artificial Sequence
  mRNA product Design2 comprising derived and/or modified sequence from Sus scrofa__K7GPE9__SsAMELX-004 (opt11)
ggggcgcugccuacggagguggcagccaucuccuucucggcaucaagcuuaccaugggaaccuggauccucuucgccugccuccucggcgcagccuucuccaugccccuccccccccaccccggccaccccggcuacaucaacuucuccuacgaaguccucaccccccuaaaaugguaccaaaacaugauccgccaccccacaccccaaucacacgcccuccaaccccaccaccacauccccaugguccccgcacaacaacccggcaucccccaacaacccaugaugccccuccccggccaacacuccaugacacccacccaacaccaccaacccaaccuaccccuccccgcccaacaacccuuccaaccccaacccguccaaccccaaccccaccaaccccuccaaccccaaucccccaugcaccccauccaaccccuccucccccaacccccccucccacccauguucuccaugcaaucccuccuccccgaccucccacucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3551 - RNA, 904 nt, Artificial Sequence
  mRNA product Design2 comprising derived and/or modified sequence from Sus scrofa__J9JIM4__SsAMELX-201 (opt11)
ggggcgcugccuacggagguggcagccaucuccuucucggcaucaagcuuaccaugccccuacccccacaccccggccaccccggcuacaucaacuucuccuacgaaguccucaccccacucaaaugguaccaaaacaugauccgccaccccuacaccuccuacggcuacgaacccaugggcggcuggcuccaccaccaaaucauccccgucgucucccaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuccccgcccaacaacccuuccaaccccaaccaguccaaccccaaccccaccaaccccuccaaccccaaucccccaugcacccaauccaaccccuacucccccaaccuccccuaccacccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3552 - RNA, 3343 nt, Artificial Sequence
  mRNA product Design2 comprising derived and/or modified sequence from Homo sapiens__NP_006120.1__HsBMP1 (opt11)
ggggcgcugccuacggagguggcagccaucuccuucucggcaucaagcuuaccaugccaggaguugcccgccuaccacuacuacuaggucuccucuuacucccgcgacccggccgcccacucgaccuagcagacuacacauacgaccucgcagaagaagacgacucagaaccacuaaacuacaaagaucccugcaaagccgcggcauuccucggagacauagcccuggacgaagaagaucuacgagcauuccagguccaacaagcaguagaccuccggcgacacacagcucgcaaaucguccaucaaagcggccgucccaggcaacacaaguaccccuuccugccaguccaccaacggucaaccccaacggggagccugcggacgcuggcguggcaggucacgaucccggcgagcagccaccagcagaccggaacgaguauggcccgacggggucaucccauucguaaucggugggaacuucacgggaucgcaacgagcaguauuccgacaggccaugcgccacugggaaaaacacacaugcgucaccuuccucgaacgcacagacgaagacagcuacauagucuucacauacagaccaugcggaugcugcaguuacgucggacggagaggcggcggcccgcaagcaauaucgauagggaaaaacugcgacaaauucggcauagucguccacgaacuagggcaugucguaggguucuggcacgagcacaccaggcccgaccgagaccgccacguaagcauaguccgcgaaaacauccaacccggacaggaauacaacuuccucaagauggaaccccaagaagucgagucgcugggggaaacauacgacuucgacuccauaaugcacuacgcccgaaacaccuucagccgagguaucuuccucgacacaaucguccccaaguacgaagucaacggcgucaaacccccaauaggccaacggacccgacucucaaaaggugacaucgcucaggcccgcaaacuguauaagugccccgccuguggggagacccuacaggacagcacgggcaacuucagcuccccugaauaccccaacggcuacagcgcacacaugcacugcgucuggcgcaucagugucaccccaggagagaaaaucauccucaacuucaccucacucgaucucuaccgaagcagacucuguugguacgacuacguggagguccgagacggguucuggcgcaaagcaccgcuccgcggccgcuucugcggcucuaaacuucccgaacccauugucagcaccgacucgagacucugggucgaguucaggaguuccagcaacuggguaggcaaaggauucuuugcagucuacgaagccauaugcggcggcgacgucaagaaagacuacggccacauccaguccccaaacuacccagacgacuaccgccccuccaaagucugcauauggaggauacaaguaucagaaggguuucacgucggacugacauuccaaaguuucgaaauagaacgucacgacucaugcgcguacgacuaccuggaaguacgcgacggccauuccgaaagcagcacacuaauaggccgguacuguggcuacgaaaagcccgacgacauaaaaucaacaucaagcagacuguggcuaaaguucgucucggacggaagcauaaacaaagcaggauucgcagugaacuucuuuaaggaagucgacgaauguucgcgcccaaacaggggaggcugcgaacaaagaugccuuaacacacuggggucauauaagugcagcugcgaccccggauacgagcuugcaccagacaagcgaagaugugaggccgccugcggaggcuuccucacaaaacugaacggauccaucacaucacccggauggccaaaagaguaucccccgaauaaaaacugcauauggcagcuaguagcgccaacccaauaccggaucagccuccaguucgacuucuucgaaaccgaaggcaacgacgugugcaaauacgacuucgucgagguacgcagcggucuuaccgcggacucaaaacugcacggcaaauucugcggcagcgaaaaaccagaaguaaucaccagccaauacaacaacaugagagucgaauuuaaaucagacaacaccguauccaagaaaggcuucaaagcccacuucuuuuccgauaaagacgaaugcaguaaagauaacgggggcugucagcaagacugcguuaacacauucggaagcuacgaaugucaaugccgcaguggguucgugcugcacgacaacaaacacgacugcaaagaagcaggaugcgaccauaaagucaccagcacaagcggaacgaucacuagccccaacuggccggacaaauacccauccaagaaagaaugcacaugggccaucuccagcacccccggccaccgcgucaaauuaacauucauggagauggacaucgaaucacaacccgaaugcgccuacgaccaccuggagguauucgacggccgagacgccaaagcaccagugcucggccgcuucugcggcuccaagaaaccagaaccagugcuagccaccggcagucgaauguuccuccgcuucuacagugacaacaguguacaacgaaaaggauuccaagcaagccacgcaacagaaugcgguggccaaguccgggccgacgucaaaacaaaagaccuauacucacaugcucaauucggugacaacaacuacccgggcgguguagacugcgaaugggucaucgucgcagaagagggauacggggucgaacucguguuccaaacauucgaagucgaggaagagacagauuguggcuacgacuacauggaacucuucgacggguacgacagcaccgcccccagacuaggccgcuacuguggaucagguccacccgaagaagucuacagcgccggugacucaguacucgugaaauuccacagcgacgacacaauuacaaagaaaggcuuccaccuaagauacacguccaccaaauuccaggacacccuccacagccgcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3553 - RNA, 1573 nt, Artificial Sequence
  mRNA product Design2 comprising derived and/or modified sequence from Homo sapiens__NP_001191.1__HsBMP2 (opt11)
ggggcgcugccuacggagguggcagccaucuccuucucggcaucaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauucgaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauucaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3554 - RNA, 1609 nt, Artificial Sequence
  mRNA product Design2 comprising derived and/or modified sequence from Homo sapiens__NP_001193.2__HsBMP4 (opt11)
ggggcgcugccuacggagguggcagccaucuccuucucggcaucaagcuuaccaugauaccgggcaaccgcaugcucauggucguucuccugugccaaguccuacucggcggcgcaagccacgccucacucauccccgaaacugggaaaaaaaaagucgccgaaauccaaggccacgccggcggaagacgcuccggccaaucacacgaacuccuccgcgacuucgaagccacccuacuacaaauguucggccuccgccgccgcccacaacccucaaagagcgccgucauccccgacuacaugcgcgaccuauaccgacuccaauccggcgaagaagaagaagaacaaauccacuccaccggacucgaauaccccgaacgccccgccucccgagcaaacaccguacguucuuuccaccacgaagaacaccucgaaaauauccccggcaccuccgaaaacuccgcauuccgcuuccuauucaaccucuccuccauccccgaaaacgaaguaaucucauccgcagaacuccgccuauuccgcgaacaagucgaccaaggccccgacugggaaagaggcuuccaccgaauaaacauuuacgaagucaugaaacccccagccgaagucguacccggccaccucaucacacgacuucucgacacacgccuaguccaccauaacguaacucgcugggaaaccuucgacguaagccccgccguccuccgauggacccgugaaaaacagcccaacuacggccucgcaauugaagucacccaccuccaccaaacacgcacacaccaaggccaacauguccgcauaucccgaucacucccacaaggcuccggcaacugggcccaacuccguccacuccucguuaccuucggccaugacggacgcggucacgcccucaccagacgccgcagggccaaacgaucccccaaacaucacucccagcgcgcucguaaaaaaaacaaaaacugccgccgccauucccuauacguagacuucuccgacgucggcuggaacgacuggauagucgcaccccccggauaccaagccuucuacugccacggcgacugccccuucccacucgcagaccaccuaaacucaaccaaucacgccaucguacaaacccucguaaacucagucaacuccuccauucccaaagccugcugcguacccaccgaacuauccgccaucuccaugcucuaccuagacgaauacgacaaagucguccucaaaaacuaccaagaaauggucgucgaaggcugcggcugccgauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3555 - RNA, 1924 nt, Artificial Sequence
  mRNA product Design2 comprising derived and/or modified sequence from Homo sapiens__NP_001709.1__HsBMP6 (opt11)
ggggcgcugccuacggagguggcagccaucuccuucucggcaucaagcuuaccaugcccgggcuaggccgacgagcacaauggcuaugcuggugguggggccuacuaugcucaugcugcggaccaccuccccuacgcccaccccugcccgcagccgcugccgcagcugccggcggccaacuacuaggcgacggcggcucacccggccgaacagaacaacccccucccucuccccaauccucauccggauuccuauaccgcagacucaaaacccaagaaaaacgcgaaaugcaaaaagaaauccuaucaguacucggccugccacauagacccagaccccuccacggacuccaacaaccccaaccucccgcccugcgucaacaagaagaacaacaacaacaacagcaacuaccccgcggcgaacccccacccggccgccuaaaaucagcaccccuauuuaugcucgaccuuuacaacgcccucucugccgacaaugaugaagacggcgccuccgaaggugaacgccaacaauccuggccccacgaagccgccucaucaucacaacgacgacaacccccacccggcgccgcccacccacucaaccgaaaaucccuucucgcccccggaucugguuccgggggcgcuuccccacucaccuccgcacaagacagcgccuuccuaaacgacgccgacaugguuaugucauucguaaaccuagucgaauacgacaaagaauuuucacccagacaaagacaccauaaagaguucaaauucaaccucucccaaaucccagaaggcgaagucguaacagccgccgaguuccgaaucuacaaagacugcgucaugggauccuucaaaaaccaaaccuuccuaauaagcaucuaccaaguacuacaagaacaccaacaccgugacuccgaccucuuucuucuagacacccgaguagucugggccucagaagaagguuggcuugaguucgacaucaccgccaccagcaaccuauggguagucacaccccaacacaacaugggacugcaacuaucagucguaacccgcgacggcguacacguucacccccgagcagccggacucguaggucgcgacggacccuacgacaaacaacccuucauggucgccuucuuuaaagucuccgaaguacacguccgaacaacacgauccgcaucaucccgccgccgccagcaaucccggaaccgaucaacacaaucccaagacgucgcccgcgucagcucggcuucggacuacaacuccagcgaacuaaaaacagcaugccgcaaacacgaacuauacgucuccuuucaagaccucggauggcaagacuggaucaucgcacccaaaggauacgcagcaaacuacugcgacggagaaugcuccuucccccuaaaugcacacaugaacgcaaccaaccacgccaucguccaaacccucguccaccuaaugaaccccgaauauguacccaaacccugcugcgccccaaccaaacuaaacgcaaucucaguacucuacuucgacgacaacuccaacguaauccucaagaaauaccgcaacaugguuguccgugccugcggaugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3556 - RNA, 1678 nt, Artificial Sequence
  mRNA product Design2 comprising derived and/or modified sequence from Homo sapiens__NP_001710.1__HsBMP7 (opt11)
ggggcgcugccuacggagguggcagccaucuccuucucggcaucaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauucuuccacccccgcuaucaccaccgcgaauuccgauucgaccucucgaaaauacccgaaggcgaagccgugaccgcagccgaauuccgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3557 - RNA, 682 nt, Artificial Sequence
  mRNA product Design2 comprising derived and/or modified sequence from Homo sapiens__NP_006264.2__HsCCL7 (opt11)
ggggcgcugccuacggagguggcagccaucuccuucucggcaucaagcuuaccaugaaagccuccgccgcccuccucugccuccuccucaccgccgccgccuucuccccccaaggccuagcccaacccgucggcaucaacaccuccaccaccugcugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3558 - RNA, 4006 nt, Artificial Sequence
  mRNA product Design2 comprising derived and/or modified sequence from Homo sapiens__NP_001954.2__HsEGF (opt11)
ggggcgcugccuacggagguggcagccaucuccuucucggcaucaagcuuaccaugcugcucacgcugaucaucuuauuaccggucgucaguaaauuuagcuuuguaucacugagcgcaccccaacacuggucaugcccagagggcacuuuggcagggaacggcaauucgacgugcguaggaccagccccauuccugaucuucagccacggaaauagcaucuuccgaaucgacacagaaggaacgaacuaugagcaacucguagucgacgcagggguaucgguuaucauggacuuccauuacaacgagaaaagaauauacugggucgaccuagaacgacagcuccugcaaaggguauuccugaacggcucgcggcaggaacggguaugcaacauagagaaaaacgucagcggcauggccauaaacuggaucaacgaagaagugaucugguccaaccaacaggaaggcaucauaaccgucacugacaugaaaggaaacaacagccacauccuccuaucagcgcuaaaguaccccgccaaugucgcggucgacccaguagaacgguucauuuucugguccuccgaaguagcugggagccuuuaccgcgcagaccuagacggcgucggaguaaaagcacuacuugaaacauccgagaaaauaacagcaguaucccuugacguccuagacaagcgccucuucuggauacaauacaaucgcgaagggucuaacagccucaucugcaguugugacuaugacggcgggagcguacacaucucaaaacacccaacacaacauaaucuauucgcgaugagccucuucggugacagaauauucuacucaaccuggaagaugaaaacaauauggauagccaacaaacacacaggcaaagacaugguccgcaucaaccuccacagcuccuucguaccccucggcgaacuaaaaguagugcacccccuagcccagcccaaagccgaagaugauacgugggaacccgaacaaaagcugugcaaacugcgcaaagggaacugcagcaguaccguuugcggucaagacuuacagucucaccucugcaugugcgcugagggguacgcccuuucgagagacagaaaauacugcgaggacgucaacgaaugcgccuuuuggaaccacggcugcacacuuggcugcaaaaauacaccgggaagcuacuacugcacaugucccguaggauucguccuucuacccgauggaaagcgcugccaccaacuggucucguguccucgcaacgucucggaaugcagccaugacugcguacuaaccuccgaagguccacuaugcuucugcccagaggguucaguucuagagcgggacggcaagacaugcaguggaugcucauccccagacaacggcggaugcucccaacuaugcgucccacugagcccggucucaugggaaugcgacugcuucccuggguacgaccuccagcuugaugaaaaaucaugcgcugccuccgggccccagcccuuccuacucuucgccaacucgcaagacauaagacauaugcacuucgacggcacagauuacgggacccugcugucccaacagaugggcaugguauacgcacucgaccacgacccaguggaaaauaaaaucuauuucgcccacacagcccuuaaguggaucgaacgcgccaacauggacggcagccaaagagaacggcucauagaagaggggguggacgugccagagggccucgcugucgacuggauagggcgccgguucuacuggacagaccggggcaaaagccucauaggcagaucagaccucaacgggaaaaggagcaagaucauaacgaaagagaauaucucgcaaccccgcggaaucgccguccacccaauggcaaaaagacuauucuggacagauacgggaauaaacccccggaucgagagcuccucccuacaagggcucgggcgguuaguaaucgccuccagcgaccuaauauggcccagcgggauuaccaucgacuuccuaacagacaaacucuacuggugcgacgcaaaacaauccgucaucgaaauggccaaucuagacgguagcaaacgacgccgacucacacaaaacgacguaggccaucccuuugcggucgccgucuucgaggacuacgucugguucucugauugggccaugcccucagucaugcgagucaacaagcgcacgggaaaggaucgagugaggcuccagggcucgauguugaaaccaagcagccuaguagucguccacccacuggcaaaaccaggcgcagacccaugccuauaccagaacgggggcugugagcacaucuguaaaaagagacuaggaaccgcauggugcucaugcagggaaggguucaugaaagcguccgacggcaaaaccugccuugccuuagacggacaccaacuccuagcaggaggcgaaguugaccuuaaaaaccaaguaacgccguuagauauccucagcaaaacaaggguaagcgaggauaacaucaccgagucacagcacaugcucguggcagaaauuauggugucagaccaagacgacugcgcacccguaggcugcucuauguacgcaagaugcauauccgaaggcgaagacgccacaugccagugccugaagggcuuugccggggacgguaaacugugcuccgacauagaugagugcgaaaugggaguacccgucuguccgcccgcaagcuccaaaugcauaaacacagaaggcggauacgugugccggugcucagaaggauaccaaggcgacggaauccacugccuggacaucgacgaaugccaguuaggugaacauucgugcggggaaaacgccuccugcacuaacaccgaaggaggcuacacaugcaugugcgccggacgucugagcgaacccgggcuaauaugccccgacuccacaccacccccacacuugcgcgaggacgaccaccauuacagcguacggaacagcgacagcgaaugcccccuaucacacgacggcuacugcuuacacgacggcgucugcauguacaucgaagcccuagacaaauacgcgugcaacugcgugguagguuacauaggugagcguugccaauaccgagaccuuaaauggugggaacuacgccacgccggacacggccaacagcagaaggucaucgucgucgcaguaugcgucguaguccucgucaugcuucuacuccuaucacuauggggcgcacacuacuacagaacucaaaaauuauuaagcaagaaccccaaaaauccguacgaggaauccagcagagauguccgcagccggagaccggcggacacggaggacggcauguccucgugcccgcaacccugguucgucgucaucaaagaacaccaagaccugaagaacggcggccaacccguagcaggagaagacggacaagccgccgacggaagcaugcaaccgaccucguggcgacaagaaccccagcuaugcggcaugggcacugagcagggcugcuggauuccaguaaguagugacaaagguagcugcccacaggucauggagcgauccuuccauaugccuucuuacggaacacaaacacuagaaggcgguguagaaaagccgcauucucuccuguccgcaaacccgcucuggcaacaacgagcacuagauccaccccaccaaauggaacucacccaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3559 - RNA, 892 nt, Artificial Sequence
  mRNA product Design2 comprising derived and/or modified sequence from Homo sapiens__NP_001423.1__HsEREG (opt11)
ggggcgcugccuacggagguggcagccaucuccuucucggcaucaagcuuaccaugaccgccggccgccgcauggaaaugcucugcgccggccgcguccccgcacuccuccucugccucggcuuccaccuccuucaagccguccucuccaccaccgucauccccuccugcauccccggcgaauccuccgacaacugcaccgcccuaguccaaaccgaagacaacccacgcgucgcccaagucuccaucacaaaaugcuccuccgacaugaacggcuacugccuccacggccaaugcaucuaccucgucgacaugucccaaaacuacugccgcugcgaagucggcuacaccggcguccgcugcgaacacuucuuccucaccguccaccaaccccucuccaaagaauacgucgcccucaccgucauccucaucauccucuuccucaucaccgucgucggcuccaccuacuacuucugccgcugguacagaaaccgcaaauccaaagaacccaaaaaagaauacgaacgcgucaccuccggcgaccccgaacucccccaagucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3560 - RNA, 850 nt, Artificial Sequence
  mRNA product Design2 comprising derived and/or modified sequence from Homo sapiens__NP_000791.1__HsFGF1 (opt11)
ggggcgcugccuacggagguggcagccaucuccuucucggcaucaagcuuaccauggccgaaggcgaaaucaccaccuucaccgcccucaccgaaaaauucaaccucccccccggcaacuacaaaaaacccaaacuccucuacugcuccaacggcggccacuuccuccgcauccuccccgacggcaccgucgacggcacccgcgaccgcucagaccaacacauccaacuccaacucuccgccgaauccgucggcgaaguauacauaaaauccaccgaaaccggccaauaccucgccauggacaccgacggccuccucuacggcucccaaacccccaacgaagaaugccucuuccucgaacgccucgaagaaaaccacuacaacaccuacaucuccaaaaaacacgccgaaaaaaacugguucguaggccucaaaaaaaacggcuccugcaaaagaggcccccgcacccacuacggccaaaaagccauccucuuccucccacuccccgucucaucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3561 - RNA, 1249 nt, Artificial Sequence
  mRNA product Design2 comprising derived and/or modified sequence from Homo sapiens__NP_001997.5__HsFGF2 (opt11)
ggggcgcugccuacggagguggcagccaucuccuucucggcaucaagcuuaccaugguggggguagggggaggggacguggaggacguaacgccgaggccgggagggugucagauaagcgggagaggggcgagagggugcaacggaauaccgggagcggcggcgugggaggcggcgcugccgaggaggaggccgaggaggcacccgagcguaaacccaagaagcagagcagcagggagcccgaggacgagggggagaaggacggaggagaggccgagugggagcaggcugggggaucgggggagggggagagcacugccgggagggcgacuagggggaagagggagggggagggcgccggagagggugggagggagggggagggggagggggacggcggcgccgagagcggcgccggcggcgagggggagcaggccgggaccggcggggacgauggcagcggggagcauaaccacguugccggcgcugccggaagauggagggaguggggcguucccaccggggcacuucaaggauccgaagagacuguauuguaagaauggaggguucuuucuaaggauacauccggaugggagaguggauggggugagggaaaagagugacccgcacauaaagcugcaguugcaggcggaggagagagggguaguaagcauaaagggggugugcgcaaauagguaucuggcgaugaaggaggaugggaggcuauuggcgagcaagugugugacggacgagugcuuuuucuuugaaaggcuagagagcaauaacuacaacacguacaggagcagaaaguauacgagcugguauguggcgcugaagagaacgggacaguacaaguuagggagcaagacagggccagggcagaaggcaauauuguuccugccaaugagugcaaagagcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3562 - RNA, 967 nt, Artificial Sequence
  mRNA product Design2 comprising derived and/or modified sequence from Homo sapiens__NP_002000.1__HsFGF7 (opt11)
ggggcgcugccuacggagguggcagccaucuccuucucggcaucaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauucuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3563 - RNA, 1009 nt, Artificial Sequence
  mRNA product Design2 comprising derived and/or modified sequence from Homo sapiens__NP_001936.1__HsHBEGF (opt11)
ggggcgcugccuacggagguggcagccaucuccuucucggcaucaagcuuaccaugaaacuccuccccuccguaguccucaaacuauuccucgcagccguccuauccgcccucgucaccggcgaaucacucgaacgccuccgccgcggccucgccgcaggcacaagcaaccccgacccccccaccgucuccaccgaccaacuccucccccuaggcggcggccgagaccgcaaaguccgcgaccuccaagaagcagaccucgaccuccuccgcgucacccucuccuccaaaccccaagcccuagcaacccccaacaaagaagaacacggcaaacgaaaaaaaaaaggcaaaggacuaggcaaaaaacgcgaccccugccuccgcaaauacaaagacuucugcauccacggcgaaugcaaauacgucaaagaacuacgcgcccccuccugcauaugccaccccggcuaccacggcgaacgaugccacggccuaucccuccccguagaaaaccgacuauacaccuacgaccacaccaccauccucgccgucgucgccgucguccucucauccgucugccuacucguaaucguaggacuccucauguuccgcuaccaccgccgaggcggcuacgacgucgaaaacgaagaaaaagucaaacucggcaugaccaacucccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3564 - RNA, 2569 nt, Artificial Sequence
  mRNA product Design2 comprising derived and/or modified sequence from Homo sapiens__NP_000592.3__HsHGF (opt11)
ggggcgcugccuacggagguggcagccaucuccuucucggcaucaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3565 - RNA, 2308 nt, Artificial Sequence
  mRNA product Design2 comprising derived and/or modified sequence from Homo sapiens__NP_005336.3 __HsHSPA1A (opt11)
ggggcgcugccuacggagguggcagccaucuccuucucggcaucaagcuuaccauggcaaaagcagcagcaauaggcaucgaccuaggaaccaccuacucaugcgucggagucuuccagcacggcaaaguagaaauaaucgcuaacgaccaaggaaacagaaccacgcccucguacgucgccuucaccgacaccgaacgacugauaggggacgcagcaaagaaccaggucgcacucaacccacaaaauacagucuucgacgcaaaaagacucauaggcagaaaauucggcgaccccguagugcaaagcgacaugaaacacuggccauuccaagugauaaacgacggggacaaaccaaaaguccaagucucauacaaaggcgaaacaaaggcauucuacccagaagaaaucuccagcauggucuuaaccaaaaugaaagaaauagccgaagcauaccucgguuacccaguaacgaacgcagucauuacaguacccgcauacuucaacgacagccaacggcaagccacgaaagacgcgggagucauagcagggcucaacguauuaagaauaaucaacgaaccaacagcagcagccaucgcauacggccuggaucgcacaggcaagggcgaaagaaacguacugaucuuugaccuaggcgggggcacguucgacguaagcauccugaccauagacgacgggauuuucgaggucaaagcaacagcaggggacacacaccugggcggggaagacuucgacaacagacucgugaaccacuucguagaagaguucaaacgcaaacacaagaaagacaucucgcagaacaaaagagcagugagaagacuacggaccgcgugcgagcgcgcaaaacgcacccuaagcucaagcacgcaggcgagccuggaaauagacagccucuucgaaggaaucgacuucuacacaucuauaacaagagcgagauucgaagaacugugcuccgaccucuuccgcuccacgcuggagccagucgaaaaagcgcuccgggaugcgaaacuggacaaagcacaaauccaugaccucguacuggucggaggcucgacccgcauuccaaaagugcaaaaacuccuccaggacuucuucaacggacgagaccucaacaaaucaaucaaccccgacgaagcagucgcguacggggccgcuguccaagccgcaauccugaugggggacaaaagcgagaaugugcaagaccuccuccuccucgacguggccccacucucgcuuggacucgagaccgcgggaggcguaaugacagcacucauaaaaagaaauucaacaaucccaacaaagcagacacagaucuucacaacguauagcgacaaucaaccgggcguacucauacaaguauacgagggcgaacgcgcaaugacgaaggacaacaaccuucuaggcagauucgagcucucaggcauaccaccagccccacgcgggguaccgcaaauagaagugacauucgacaucgacgcaaacggaaucuuaaacguaacagcgaccgauaaaucaaccggaaaggcgaacaaaaucacaaucacaaacgacaaaggacgccuuucaaaagaagagaucgagagaaugguacaggaggcagaaaaguacaaagcagaggacgagguccaacgcgaaagaguauccgccaaaaacgcccuggaaucauacgcauucaacaugaaguccgccgucgaagacgaaggucuaaagggaaagauauccgaagccgacaaaaagaaaguacuagauaaaugccaagaagucaucagcuggcucgacgcaaacaccuuggccgaaaaagacgaauuugaacacaaaagaaaagaacuugaacaaguaugcaaucccauaaucucaggccuguaccaaggcgcaggcgggccagggcccgggggcuuuggggcacaaggccccaaaggaggaagcggaagcgggccgacaauagaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3566 - RNA, 2308 nt, Artificial Sequence
  mRNA product Design2 comprising derived and/or modified sequence from Homo sapiens__NP_005337.2 __HsHSPA1B (opt11)
ggggcgcugccuacggagguggcagccaucuccuucucggcaucaagcuuaccauggcgaaagcagcagcaaucggaaucgaccucgguaccacauacagcugcguaggcguauuccaacacgggaaaguagaaaucauagcaaacgaccaagggaaccggacaacccccuccuacgucgccuucaccgacacagaacgacuuaucggcgacgcagccaaaaaccaggucgccuuaaacccccaaaacaccgucuucgacgcaaaaagacucaucggaagaaaauucggggaccccgugguacaaagcgacaugaaacacuggcccuuccaaguaaucaacgacggagauaagcccaagguccaaguaucguacaaaggcgagaccaaagccuucuacccagaagaaauaucaagcaugguguuaaccaagaugaaggaaaucgccgaagccuaccucggcuacccagugacaaacgccguaauaaccgugcccgcguacuucaaugacucccaacgccaagccacgaaagacgccggcgucauagccggacuaaacguacuacgcauaauaaaugaaccgacagcagccgccaucgcauacggacucgaccgcacaggcaaaggcgaaagaaacguauugauauucgacuuaggcggaggcaccuucgacgucucgauacuaaccauagacgacggaauauucgaggucaaggccaccgccggagacacacaccuaggcggcgaagacuucgauaaucgucuagugaaccacuucguagaagaguucaagcgcaaacacaagaaagacaucucccaaaacaaacgugcagugcgaaggcuaagaaccgcaugcgaacgcgcaaaaagaacccucagcuccagcacacaagcgagccuagaaauagacagucucuucgaaggcaucgauuucuacaccucgauaacuagagcgcgcuucgaagaauuaugcagcgacuuauuccgaucgacauuagaaccuguagaaaaagcgcuccgggacgcgaaacuagacaaagcccaaauccacgacuugguccugguagggggcucuacaaggauaccgaaagugcaaaagcuauuacaagacuucuucaacggacgcgaucucaauaaauccaucaaccccgacgaggcaguagcauacggcgccgcgguccaggcagcgauacucaugggagacaaaucagaaaacgugcaagaccuccugcuccuugacguagcaccacucucgcucggacuagaaacggcgggaggggucaugaccgcacucaucaagagaaacaguaccaucccaaccaaacaaacccaaaucuucaccacauacucagacaaccaaccgggagugcuaauccaaguauacgaaggcgaacgcgcgaugaccaaagacaauaaccugcuaggaagauucgaacuaucaggcauacccccggcuccacgaggcgucccccaaaucgaaguaaccuucgacauagacgccaacggaauccucaacgugacagcgaccgacaaaagcaccgggaaagcaaacaaaaucacaaucacaaacgacaaaggacgauuaagcaaagaagagaucgagcgaaugguccaagaagccgaaaaguacaaagccgaagacgagguccaacgcgaacgaguaagcgccaaaaacgcauuagaauccuacgcguucaauaugaaaagcgcaguagaagacgaaggacugaaagggaaaauaagcgaagcagacaaaaagaaaguacucgacaaaugccaagaaguaaucuccuggcuagacgcaaauacccucgccgaaaaagacgaguucgaacacaaaagaaaagaacuggaacaagugugcaacccaauuaucucaggacuauaccagggggcaggcgggccaggacccggaggauucggcgcgcaaggaccaaaaggaggcagcggaagcggaccaacaaucgaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3567 - RNA, 2308 nt, Artificial Sequence
  mRNA product Design2 comprising derived and/or modified sequence from Homo sapiens__NP_005518.3 __HsHSPA1L (opt11)
ggggcgcugccuacggagguggcagccaucuccuucucggcaucaagcuuaccauggcgacagcaaagggcauagcaauaggcaucgaccucggcaccacauacuccugcguaggcgucuuccaacacggcaaaguagaaaucaucgcaaacgaccaaggaaacaggacaacacccucauacgucgcauuuaccgacaccgaaagacuuaucggagacgcggccaaaaaccaggucgcaaugaacccccaaaauaccgucuucgacgcaaagcgacucauaggacgcaaauucaaugaccccgugguacaggcagacaugaaacuauggccguuccaaguuauaaacgaaggcggaaagccgaaaguccucguauccuacaaaggcgaaaacaaagccuucuaccccgaggaaaucucgagcaugguccuaaccaaacucaaagaaacagccgaagcauuccucgggcacccagucaccaacgcggucauaaccguaccagcauacuucaacgacucgcaaagacaggcaaccaaagacgccggagucaucgcaggacugaacguccuccgaaucaucaacgaaccaaccgccgcagccaucgccuacggacuagacaaaggcgggcaaggcgaacggcacguacuuaucuucgaccucgggggcggaaccuucgacgucuccauccugaccaucgacgaugggauauucgaagucaaagccacggccggagacacacaccucggaggcgaagacuucgacaaccgccuaguaagucacuucgucgaagaguucaaacgaaaacacaaaaaggacaucagccagaacaaacgagcaguacgccgccucaggacagcaugcgaacgcgccaaaaggacacuaagcuccuccacgcaagcaaaccucgaaauagacagccuauacgaaggaauagacuucuacacaagcaucacaagggccagauucgaagaacucugcgcagaccuauuccggggcacacucgaaccagucgaaaaagcgcugcgagacgccaagauggacaaagccaaaauccaugacauaguccucgucggaggcuccacccgaauccccaaaguacaacgacuucuacaggauuacuucaacggaagagaucucaauaaaucaaucaaccccgacgaggcggucgcauacggcgccgccgugcaggccgcaauacucaugggggacaaaagcgagaaaguacaagaccuguuacuacuggauguggcaccccuaagccucgggcuggaaaccgccggaggggucaugaccgcccucaucaaacgaaacuccacgauccccacaaaacaaacccaaauauucaccaccuacuccgacaaccagccaggaguacuaauccaaguauacgaaggagaacgcgccaugacaaaagacaacaaccuacuaggccgguucgaucuaacaggcauaccaccggcgccccgagggguaccccaaaucgaaguaacauucgacaucgacgccaacggcauacugaacgugaccgcaacggacaaaucgaccgggaaagugaacaaaauaacaaucacaaacgacaagggccgcuuaagcaaggaagaaaucgagcgcaugguccuagacgcagaaaaauacaaagccgaagacgaaguacaacgagagaaaaucgccgcgaagaacgcgcuggaaagcuacgcauucaacaugaaaagcguaguaucagacgagggacuaaaaggcaaaauaagcgaaagcgacaaaaacaaaauacucgacaaaugcaacgaacuacuaagcuggcuagaagucaaucaacucgccgaaaaagaugaguucgaccacaaacgcaaggaacucgaacaaaugugcaacccaauaaucaccaaacuuuaccaaggaggcugcacaggcccagcaugcggaacaggcuacguaccaggccgaccugccaccggccccaccauagaagaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3568 - RNA, 2302 nt, Artificial Sequence
  mRNA product Design2 comprising derived and/or modified sequence from Homo sapiens__NP_068814.2 __HsHSPA2 (opt11)
ggggcgcugccuacggagguggcagccaucuccuucucggcaucaagcuuaccaugagugcgcgcggacccgcaaucggaauagaccucggcaccaccuacucaugcgugggcguauuccagcacggaaaagucgaaauaaucgcaaacgaccaagggaacagaaccacaccauccuauguggccuuuacugacaccgaacgccuaaucggagacgcugccaagaaccagguagcaaugaaccccacaaacacaaucuucgacgcaaagaggcuaaucggacgcaaguucgaagacgcaacaguccaaagcgacaugaagcacuggcccuuccgcguaguauccgaaggaggcaaacccaagguccaagucgaauacaaaggcgagacaaagaccuuuuucccagaagagaucucaagcaugguacucaccaaaaugaaagaaauagcggaggcauaucuuggaggaaagguccacagcgcagugauaacaguccccgcauacuuuaacgacagccaaagacaagcaacaaaagacgcaggaaccauaacaggacuuaacguccuccgaauaaucaaugaaccaacagcagcagcaaucgcauacggccuagacaagaaaggcugcgccggaggcgagaaaaacguccuaauauucgaccuaggcgggggaacguucgacgucucaauacucaccauagaagacggcaucuucgaggucaaaagcacggccggagacacacaccucggcggggaagacuucgacaaccgcauggugagccaucucgccgaagaguucaaaagaaagcacaagaaagauauaggccccaacaaacgggcagugagaaggcucaggaccgcaugcgaacgggcgaaaagaacccucagcucaagcacacaagcaaguauugaaaucgacucccuauacgaagggguagacuucuacaccucaaucacacgggcccgcuuugaggaacuaaacgccgaucuguuccgcggaacacuagaaccagucgaaaaagcacuccgagacgcaaaauuagacaaaggccaaauucaagaaauaguccuggucggagguuccacccgcaucccaaaaauccaaaaacuacuacaagacuucuucaacgggaaagaacucaacaaaucaauuaaccccgaugaagcagucgccuacggagcagcaguacaagcagcgauacucaucggggacaaaagcgagaacguccaagaccuacuacugcuagacgugaccccacucucacucgggauagagacagcaggcggaguaaugaccccacugauaaaacgaaacacaaccauacccacaaaacagacccagaccuucacaaccuacagcgacaaccagucauccguacucguccagguguacgagggagaacgagcaaugacgaaagacaacaaccuauugggcaaguucgaccuaacgggcauaccgcccgcgccccgcgguguaccacaaaucgaagucacuuuugacauagacgccaacggaauccuaaacgugaccgcggccgacaaaagcacagggaaggaaaacaagaucacaauaacaaacgacaaagggagacugagcaaagacgacauugaccgaaugguccaagaagcagaacgcuacaaaucugaagaugaggcaaacagagaccgagucgcugcaaagaacgcacuggaaucuuacaccuacaacaucaagcagaccgucgaagacgaaaaacugcgaggaaaaauaagcgaacaagacaaaaacaaaauacuggacaaaugucaagaagucauaaacuggcucgaccgaaaccaaauggccgaaaaagacgaauacgaacacaaacaaaaagaacucgaacgaguaugcaaccccauaaucucaaaauuauaccaaggaggcccaggaggcgggagcggcggaggaggcuccggagcgagcggaggccccaccaucgaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3569 - RNA, 2905 nt, Artificial Sequence
  mRNA product Design2 comprising derived and/or modified sequence from Homo sapiens__NP_002145.3 __HsHSPA4 (opt11)
ggggcgcugccuacggagguggcagccaucuccuucucggcaucaagcuuaccaugucggucguaggaaucgaucugggcuuucaaucaugcuacguugcaguggcgagagcaggaggaaucgaaaccauagccaacgaauacagcgauagguguacgccggcaugcaucagcuucggccccaaaaacagaucaauaggagcagccgccaaaucacaagucaucuccaacgcaaagaacaccguacaaggcuucaagcgauuccauggcagagccuuuucggacccguucgucgaagcugaaaaauccaacuuagcguacgacauaguucaacucccaacaggauuaaccggcaucaaagucaccuacauggaagaggagcgaaacuuuaccaccgaacagguaaccgcgaugcuccuaagcaagcuaaaggaaaccgcagaaagcguccucaaaaagcccgucguagauugcguggucuccgucccaugcuucuacacggacgcagaacgucgcagcguaauggacgccacacaaauagccggacucaacugccuacggcugaugaacgaaacgaccgcagucgcacuggccuacgggauauauaagcaagaccuaccagcgcuggaagaaaaaccacguaacguggucuucgucgacaugggacacuccgccuaccaagucuccgugugcgcguucaaccgcggcaaacucaaaguccucgcaacagcguucgauaccacauugggcggacgcaaguucgaugaaguacucguaaaccacuucugcgaggaguucggcaaaaaguacaaacucgacaucaaaucgaaaauacgagcacuacuccgccuuagccaagaaugugaaaaacuaaagaaacugaugucagcaaacgccagcgaccuaccacuaucaauagaaugcuucaugaacgacguagacguaagcggaacgaugaaucgcggaaaauuccuggaaaugugcaacgaccuccucgcccgaguugagccgccacuacggagcgugcucgaacaaaccaagcucaagaaagaagacauauacgccguagaaauagucgggggcgcaacccgcauccccgccgugaaagagaaaaucucaaaauucuucgggaaagaacucagcaccacacucaacgccgacgaagcggugacccgaggcugcgcgcuccaaugcgcaauccuaagccccgccuucaaaguacgagaguucuccauaaccgacguaguccccuaucccauaucccuuagguggaauagccccgcagaagaaggcagcagcgacugcgaaguauucagcaaaaaccacgccgcacccuucucaaaaguacugaccuucuaccgaaaagaaccauucacacucgaggcauacuacagcuccccacaggaccucccauacccagacccggccaucgcccaauucagcguacaaaaagucacaccacaaagcgacgguagcucgagcaaagucaagguaaaaguccgggucaacguucacggcauauucucaguaagcagcgcaagccucguagaaguacacaaauccgaggaaaacgaagaacccauggaaaccgaccaaaacgccaaagaagaagagaaaaugcaaguagaucaagaggaaccacacgucgaggaacaacagcaacagacccccgccgaaaacaaagcagaaagcgaagaaauggaaaccagccaagccggcuccaaagauaagaaaauggaccaaccaccacaagccaaaaaggccaaagucaaaacauccacagucgaucuccccauagaaaaccaacuacuauggcaaaucgaccgcgagaugcucaacuuauacauagagaaugaaggcaaaaugauaaugcaagacaaacucgaaaaagagagaaacgacgccaaaaacgcagucgaagaauacgucuacgaaaugcgagacaaacuaagcggcgaauacgagaaauucguaucggaagacgacagaaacagcuucacccuaaagcuggaggacaccgaaaacuggcuauacgaagacggagaagaccaacccaaacaaguauacguagacaaacucgcagaacucaaaaaccuaggccaacccaucaaaauacgauuccaagaauccgaggaacgccccaaauuauucgaagaacucggcaagcaaauccaacaguacaugaaaauaauaucgagcuucaaaaacaaagaagaccaauacgaucaccuggacgcagcagacaugacuaaaguagaaaaaucaacaaacgaagcaauggaauggaugaacaacaaacucaaccuucaaaacaagcaaagccuuaccauggacccaguagucaaaagcaaggaaaucgaagccaagaucaaagagcucacaucaaccuguuccccuaucauaucaaaacccaaaccaaaaguagaaccacccaaggaagaacagaaaaacgccgaacaaaacggccccgucgacggacaaggcgacaaccccggcccccaagccgccgaacaagggaccgacaccgcaguaccaagcgacagcgauaagaaacuucccgaaauggacaucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3570 - RNA, 2902 nt, Artificial Sequence
  mRNA product Design2 comprising derived and/or modified sequence from Homo sapiens__NP_055093.2 __HsHSPA4L (opt11)
ggggcgcugccuacggagguggcagccaucuccuucucggcaucaagcuuaccaugucagucgucggcaucgaucucggguuccugaacugcuacauagcagucgcccggaguggagggaucgagacaauagcaaacgaauacucggaccgcugcacacccgcaugcauaagccucggcuccagaacgagagccaucgguaacgccgcuaagagccaaaucguaaccaacguacgcaacacaauccacggcuuuaagaaacuccacggcagaucguuugacgacccuauaguccagacagagcgcauacgacugcccuacgaacuacagaaaaugccaaacgggagcgcgggcgucaaaguccgauaccuagaagaggagcgcccauucgcaauugaacaaguaacuggaaugcugcuagcaaaauuaaaagaaacgagcgaaaacgcccuaaagaaacccguagccgauugcguuaucucaauaccgagcuuuuucacagacgcagagcggcgcucagucauggccgcagcccaagucgccggccucaacugccuccgccucaugaacgaaacaacugccguugcccuggccuacggcaucuacaaacaagaccuaccgccccuggacgagaaaccgcgaaacgucgucuuuaucgacaugggacacuccgcauaccaaguucuaguaugcgccuucaacaaaggcaagcucaaaguacuggcaaccacauucgaccccuaccucgguggacgaaacuucgaugaagcgcucgucgacuacuucugcgacgaguucaaaacgaaauacaaaaucaacgucaaggagaacucccgggcccugcuaagacucuaccaagagugcgaaaaacuaaagaaacuuaugucggcaaacgccucagaccugccccucaacauagaauguuucaugaaugaccucgacguaagcuccaaaaugaaccgcgcacaauucgagcaacuaugcgccagccugcuagccaggguagaaccuccacuaaaagcagucauggagcaggcuaaccuacaacgcgaggacauaagcagcaucgagaucgugggaggcgccacacgcauacccgcagucaaagaacaaaucaccaaauuuuuccuaaaagacaucucaaccacccucaacgccgacgaagcaguagcgcgcggcugcgcccuccaaugcgcgauacucagcccagccuucaagguacgcgaguucaguaucaccgaccucguccccuacucaauaacacuaagauggaaaaccucguucgaagacggcuccggagaaugcgaaguauucugcaagaaucacccggcaccguucucgaagguaaucaccuuccacaagaaagaacccuucgaacuugaagcauucuacacaaaucuucacgagguaccauacccggacgcacgcauaggcucauucaccauccaaaacgucuucccccaauccgacggcgacucaagcaaagugaaagugaaaguccgcguaaauauccacggaauauucuccguagcaagcgcaucaguaaucgagaaacaaaaccucgaaggcgaccacagcgacgcaccaauggagaccgaaaccagcuucaagaacgagaacaaggacaauauggacaaaaugcaaguagaccaggaagaaggacaccagaaaugccacgcagaacacacccccgaggaagaaaucgaccacacaggcgccaaaacaaaauccgccguaagcgacaaacaggaucgccuaaaccagacgcucaaaaaggggaaagugaaauccauagaccuacccauccaguccucacuuugccgccagcuaggccaggaccuucugaacucauacaucgaaaacgaggggaaaaugaucaugcaagacaaacucgaaaaggaaaggaaugacgccaaaaacgcagucgaagaauacguauacgacuuccgcgaccgacugggcacaguauacgaaaaauucauuacacccgaagaccucaguaagcuaagcgcggucuuggaggacaccgagaacuggcucuacgaagacggcgaggaccagcccaaacaaguauacguggacaaacuacaagaacucaaaaaguacggacaaccuauccaaaugaaguacauggaacacgaagaacgcccaaaagcucuaaacgaccuaggcaagaagauacagcucguaaugaaggucaucgaagccuaccgcaacaaagacgaaagauacgaccaccuagacccaaccgaaauggaaaaaguagaaaaaugcauaagcgaugcaaugagcuggcucaacucuaagaugaaugcacaaaacaaacucucccuuacccaagacccagucguaaaagucucagaaauugucgcgaaaagcaaagagcuagacaacuucugcaaucccaucaucuacaagcccaaacccaaagcagaaguacccgaagacaaacccaaagccaacuccgaacacaacggcccgauggacggccaaagcggaaccgaaacaaaguccgacaguaccaaagacagcucgcagcacaccaaguccuccggcgaaauggaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3571 - RNA, 2347 nt, Artificial Sequence
  mRNA product Design2 comprising derived and/or modified sequence from Homo sapiens__NP_005338.1__HsHSPA5 (opt11)
ggggcgcugccuacggagguggcagccaucuccuucucggcaucaagcuuaccaugaaacuaagccuggucgcagcaaugcugcuacuacuaagcgcagcaagggcagaggaagaagacaagaaagaggacgucggcacaguagucggaauagaccuggggacgaccuacagcuguguaggggucuucaagaacggcagaguugaaaucaucgcaaacgaccaaggcaaccgaauaacaccgagcuacguagcguucacacccgaaggcgaaagacucaucggggacgcagccaaaaaccaacuaacaagcaacccggaaaacacaguguucgacgccaaaagacuaaucggcagaaccuggaacgaccccuccguccaacaagacauaaaauuccucccauucaaagugguagaaaagaaaacgaaacccuacauacaagucgacauagggggcgggcagacaaaaacauucgcgccagaagaaaucagcgcaaugguccuaaccaaaaugaaagaaacggcagaagcguaccugggaaagaaagucacccacgccgucgucacgguccccgccuacuucaacgacgcgcaacgacaagcaaccaaagacgcaggcacgaucgcgggacugaacguaaugaggauaaucaacgaaccaacagcagccgccaucgcauacggacuggacaagcgcgaaggagagaaaaacauacuggucuucgaccugggcggaggaacauucgacgucucgcuacugacaauagacaacggcguauucgaggucguggcuacgaacggagacacacaccuaggaggggaagacuucgaccaacgagucauggaacacuucauaaaacuauacaagaagaaaaccggaaaagacguaagaaaagacaacagagccguacaaaaacugaggcgcgaaguagaaaaagcgaaacgggcccugagcucgcaacaccaagcgagaauagaaauagaguccuucuacgaaggagaagacuucagcgaaacacuaacgcgcgccaaauucgaagaacucaacauggaccucuuccgcucaacuaugaagcccguccaaaaagugcucgaagacagcgaccugaaaaagagcgauaucgacgaaauaguacugguaggcggaagcacacggaucccaaaaauacagcaacucgugaaagaguucuucaacggaaaagaaccaucgcgagggaucaacccagaugaagcggucgcauacggugcagcgguccaggccgggguacuaagcggagaccaagacacaggagaucugguacuccuugacgugugcccacuaacccucgggauagagaccguaggcggcguuaugacaaaacugaucccccgcaacaccguaguacccacgaagaaaagccaaaucuucagcacggcaagcgacaaccaaccgaccguaaccauaaaaguguaugagggggaacgaccccucacgaaagacaaccaccuacucggcacauucgaccucacaggaauaccaccagccccgcgcggaguaccacaaaucgaaguaacguucgaaaucgacgugaacggaauccuacgcgucaccgccgaggacaaagggaccggcaacaagaacaaaaucaccaucacgaacgaccaaaaccgccucacaccggaggaaaucgaacguauggucaacgacgcggaaaaguucgcggaagaggacaagaaacucaaagaacgcauagacacgcgaaacgaacuggaaucauacgcauacucacugaaaaaccaaauaggagacaaggaaaagcuaggaggcaagcuaucgagcgaggacaaagaaacaauggaaaaggcagucgaggagaaaauagaauggcuagaaucccaccaagacgcagacauagaagacuucaaagcgaaaaagaaagaguuagaagaaaucguucaaccaaucaucagcaaacuauacgguagcgcaggcccaccgccuacaggcgaggaagauaccgcagaaaaagacgagcuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3572 - RNA, 2314 nt, Artificial Sequence
  mRNA product Design2 comprising derived and/or modified sequence from Homo sapiens__NP_002146.2__HsHSPA6 (opt11)
ggggcgcugccuacggagguggcagccaucuccuucucggcaucaagcuuaccaugcaagccccacgagagcuagcaguaggaauagaccucggaacuacauacucaugcguaggcguauuccaacaaggacgcguagaaauacucgcaaacgaccaaggcaaccgcaccacgccaagcuacgucgccuuuaccgacaccgagagacucguaggcgacgcagccaaaucgcaggccgcccucaauccccacaacaccgucuucgacgcgaaaagacuaaucggccgaaaauucgccgauaccacaguccaaagcgacaugaaacacuggcccuuucgcguagugucagaaggaggaaaaccaaaagucagggucugcuaccgaggagaagacaaaaccuucuacccagaagagauaucgaguaugguacuauccaaaaugaaggaaaccgcagaagccuaccuaggacaaccaguaaagcacgccgucauaacaguaccagcguacuucaacgacagccaaagacaagccaccaaggacgccggggccauagccggacuaaacguccuccgcauaaucaacgaaccgaccgcugccgcgaucgcauacggccucgaccgcaggggagcuggcgaaagaaacguccucaucuucgaccucggagggggaacauucgacgucucaguacuaaguauagacgccggcguauuugaaguaaaagccacagcaggcgacacccaccuaggaggagaagacuucgacaaccgacucgugaaccacuucauggaagaguuccgacgcaaacacggcaaagaccucuccggcaacaaacgggccuugagacgacucagaacagccugcgaaagagcaaaaagaacacucagcucaagcacacaagcgacauuagaaauagacucccuauucgagggcguagacuucuauaccucgaucacacgcgcaagauucgaggaacugugcucagaccucuucagaucaacccucgaaccggucgagaaagcucuaagagacgccaaacuagacaaagcacaaauccacgacgucgucuuaguaggcggaagcacccgaauaccaaaagugcaaaaacuccuacaagacuucuucaacggaaaggagcucaacaagucaauaaaccccgacgaagccgucgcauacggggccgcaguacaggccgcagugcucaugggcgauaaaugcgagaaaguccaagaccuucuacuacucgacguagccccacuuucccuagggcucgaaaccgcgggcgggguaaugaccacccucauccaacgaaacgcaacaauaccaacuaaacaaacccagaccuucacaacauacucagacaaucaaccgggaguauucauacaagucuacgaaggcgaacgagccaugacaaaagacaacaaccuucucggcagguuugaacucagcggcauacccccagccccacgcggcgucccacaaauagaagucaccuucgauauagacgccaacggcauacucagcguaacggcaaccgaccgcagcaccggaaaagcgaacaagauaaccaucacaaacgacaaagggcgccuaagcaaagaagaggucgagcgcaugguccaugaagcagaacaguauaaagcagaggacgaagcccaacgagacagaguagcagcgaaaaacagucucgaggcacacguguuccacgucaaaggcucacuacaagaagagagccuacgagacaaaauccccgaagaagacaggcggaaaaugcaagauaaaugccgcgaaguacucgcuuggcucgagcacaaccaacuggccgaaaaggaggaauacgaacaccaaaaacgagaacucgagcagauaugccgacccauauucucccgccucuacggcggccccggcguccccggaggaagcagcugcggcacgcaagccagacaaggagaccccucaaccggacccauaaucgaagaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3573 - RNA, 1486 nt, Artificial Sequence
  mRNA product Design2 comprising derived and/or modified sequence from Homo sapiens__P48741__HsHSPA7 (opt11)
ggggcgcugccuacggagguggcagccaucuccuucucggcaucaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuccgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3574 - RNA, 2323 nt, Artificial Sequence
  mRNA product Design2 comprising derived and/or modified sequence from Homo sapiens__NP_006588.1 __HsHSPA8 (opt11)
ggggcgcugccuacggagguggcagccaucuccuucucggcaucaagcuuaccaugucaaaaggacccgcagugggaaucgaccuaggcaccaccuacucaugcguaggcgucuuccaacacggaaaagucgagauaaucgccaacgaccaaggaaacaggacgacaccaucauauguagccuucaccgacaccgagcgccuaauaggagacgccgccaaaaaccaggucgcaaugaacccaacgaacaccguauucgacgccaaacgacuaaucggccgccgauucgacgaugcagucguccagagcgacaugaaacacuggcccuucaugguaguaaacgacgccggccgaccaaagguacaagucgaauacaaaggcgaaaccaaauccuucuaccccgaagagguguccagcaugguccucaccaaaaugaaagaaauagcagaagcguaccuggggaaaacagucaccaacgcaguagucaccguccccgcauacuucaacgacagccagagacaagcaacaaaagacgcaggcaccaucgccgggcuaaacguccuacgcauaaucaacgaacccacagcagcugcaaucgcauacggucucgacaagaaaguuggugccgaacgcaacguccuaaucuucgaccucgggggcggcaccuucgacguaucaauccucacaauagaagacggaauauucgaagucaaaagcaccgcaggcgacacccaccuaggcggcgaggacuucgacaacagaaugguaaaccacuucaucgcagaguucaaacggaaacacaagaaagacaucuccgaaaacaaacgcgcaguacgacgccuacggacagcaugcgaacgcgccaaacgcacccucuccuccuccacccaagcaagcauagaaaucgacagccuauacgaaggaauagauuucuacacauccaucacaagggcgcgcuucgaagaacuaaacgcagaccucuuccgagguacccucgacccagucgaaaaagcauuaagagacgcaaaacuagacaaaagccaaauccacgacauaguccuggugggcggaucaacccguaucccuaaaauccaaaaacuacuacaggacuucuucaacggaaaagaacuaaacaaguccaucaacccagacgaagcuguggcauacggcgcggccguacaagccgccauccuaagcggcgacaaaucggaaaacgugcaggaccugcuacuccuagacgucacaccccucucacuaggcauagaaaccgcgggcggcguaaugaccguccuaauaaaacgaaacacaaccauaccaaccaaacaaacgcaaaccuucacaacauacagcgacaaccaaccagggguacucauccaaguauacgaaggcgaacgcgcaaugaccaaagacaacaaccuccuaggcaaauucgaacuuacaggaaucccacccgcaccccgagggguaccccaaauagaaguaacauuugacauagacgccaacggcauccuaaaugucagcgccgucgacaaaagcaccggaaaagaaaacaaaauaacgauaaccaacgacaaaggccgacugagcaaagaagacaucgagcgaaugguacaagaagccgaaaaauacaaagcagaggaugaaaaacagcgcgacaaaguaucaagcaaaaacagucuggaaagcuacgccuucaacaugaaagcaacaguggaagacgaaaaacuccaaggcaagaucaaugacgaagacaagcagaaaauccucgacaaaugcaacgaaaucaucaacuggcucgacaagaaccaaacagcagaaaaggaagaguucgaacaccaacagaaagaacucgaaaaagucugcaaccccauaaucacaaaacuguaccaauccgcaggcggaaugcccggcggcaugcccggaggauucccaggcggcggggcaccacccaguggcggagccagcucaggaccgacaaucgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3575 - RNA, 2422 nt, Artificial Sequence
  mRNA product Design2 comprising derived and/or modified sequence from Homo sapiens__NP_004125.3 __HsHSPA9 (opt11)
ggggcgcugccuacggagguggcagccaucuccuucucggcaucaagcuuaccaugauaagcgccucaagagcagcagccgccagacugguaggagccgcagcaucaaggggcccgacagcagccagacaccaagacucauggaacggccuaagccaugaagcauuccgccucguaagccgacgcgacuacgcgagcgaagcaauaaaaggagccguggucggcauagaccuaggaaccacgaacucgugcguggccguaauggagggaaaacaagcaaaaguacucgaaaacgccgaaggggcaagaacaacgcccucaguaguagcguucacugcggacggcgaaaggcuaguaggcaugccagcaaaacgacaagcggugacaaacccaaacaacacguucuacgcaacaaaacgacucauaggacgacgauacgacgacccggaaguacaaaaagacaucaaaaacgucccguucaaaauagugcgcgccaguaacggagacgccugggucgaagcccacggcaaacucuacagcccaucccagaucggcgccuucguccuaaugaagaugaaagagaccgccgaaaacuaccucggacacacagcuaaaaacgcagucaucacugugccagcguauuucaacgacagccaaaggcaagccacgaaagacgccgggcaaauaaguggacuaaacguccuaagggucaucaacgaaccgacugcagcggcccuggcauacggccuagacaagagcgaagacaaaguaauagccguauacgaccuaggaggcgggacauucgacauaagcauccuagaaauacagaaaggaguauucgagguaaaaagcacgaauggggacacguuccuggguggcgaagacuucgaccaagcacugcuacgccacaucgugaaggaguucaaacgagaaacaggggucgaccucacaaaagacaacauggcgcuccaacgaguccgcgaagcagcggaaaaagcaaaaugcgaacuaagcagcagcguacaaaccgacauaaaccuacccuaccuaacaauggacaguagcgggccaaaacaucucaacaugaaauuaacaagagcucaauucgaaggcaucguaacggaccuaauacgacgaaccaucgccccgugccaaaaagccaugcaagacgcagaaguaagcaagagcgacauaggagaaguaauacugguaggcggcaugacaagaaugccgaaaguacaacaaaccguacaagaccuauucggacgagcaccaagcaaagccgucaacccggaugaagcaguggccauuggcgcagcaauccagggaggcgugcuagcgggcgauguaacagacguacuccuacuagacguaaccccgcuaagccuaggaauagaaacccuaggcggaguauucacaaagcugauaaacagaaacacaacaaucccaaccaagaaaagccaaguauucagcaccgcggcagacgggcaaacccaaguggagaucaaagucugucaaggagaacgagagauggccggcgauaacaaacugcucggccaauucacccugaucggcauaccacccgcgccgagaggaguaccccaaaucgaggucacguucgauaucgacgccaacggcauaguccauguaagcgccaaagacaaaggaaccggacgcgaacaacaaauagucauccaaucaagcggaggccuaagcaaagacgacaucgagaacauggucaaaaacgcggaaaaauacgcagaggaagaccgaagaaagaaagaaagagucgaagcaguaaacauggccgaaggaauaauacacgacaccgaaaccaaaauggaagaguucaaagaccaacuaccagcugacgaaugcaacaaacucaaagaagaaauaaguaaaaugcgagagcuacuagcgcgcaaagacagcgaaacgggagaaaauauacgccaggcagcgagcagccugcaacaagcuagccuaaaacuguucgaaauggccuacaagaaaauggcauccgaaagggaaggaagcggaagcagcggcaccggcgaacagaaagaagaccaaaaagaagagaaacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3576 - RNA, 2410 nt, Artificial Sequence
  mRNA product Design2 comprising derived and/or modified sequence from Homo sapiens__NP_079291.2__HsHSPA12A (opt11)
ggggcgcugccuacggagguggcagccaucuccuucucggcaucaagcuuaccauggcagauaaagaagcaggcggauccgacgggccacgagaaaccgccccaacauccgcauacagcucgccagcccgaucacuaggagacaccgguauaacgccccuuucccccucccacaucgucaacgacaccgacucaaacguauccgaacaacaauccuucuuaguugucguggccgucgacuucggaacaacaucauccggcuaugccuauucauucaccaaagaaccggagugcauccacgucaugcgucgcugggaaggaggagaccccgggguuucaaaccagaaaacccccaccaccauccuucucacccccgaacggaaauuccacuccuucggcuacgccgcccgggacuucuaccacgaucuagacccgaacgaagcaaagcaauggcucuaccuagaaaaauucaaaaugaaacuucacaccaccggcgaccucacaauggauacagaccuuacagccgcaaacggcaagaaagucaaagcgcucgaaaucuucgccuacgcacuccaauacuucaaagaacaagcccucaaagagcuauccgaccaagccggcucagaguucgaaaacucagacguccgcugggucauaacaguaccugcgauauggaaacaacccgccaaacaguuuaugagacaagcagccuaccaggcuggacuggcauccccugaaaacucagaacaacucauaaucgcgcuagaacccgaagcugcaagcauauacugccgaaaacuccgccuccaccagaugaucgaacugagcuccaaagcagccguaaacggauacagcggcuccgacacugucggcgcaggauucacccaagcuaaagaacacauccgacgaaaccgccagucacgcacuuuccuagucgaaaacgucauaggagaaaucuggagcgaacuagaagaaggagacaaauacgucguggucgauucaggcggcggcaccgucgaccuaacaguccaccaaaucaggcuaccagagggccaccucaaagagcuauacaaagcaaccggcggccccuacggaucccucgguguagacuaugaguucgagaaacugcucuacaaaauauuuggcgaggacuuuaucgagcaauucaaaaucaaacgccccgccgccugggucgacuugaugaucgccuucgaaagccgaaaacgcgccgccgcccccgacagaacaaacccacuaaacaucaccuuacccuucucguucaucgacuacuacaagaaauuucgcggccacuccgucgagcacgcccuacgaaaaagcaacgucgacuucgucaaauggucaucgcaaggaaugcuccguaugucccccgacgccaugaaugcccuauucaaacccacaauagacuccaucaucgaacaccuccgcgaccucuuucaaaagccagaaguaucaaccgucaaauuucucuuccuagucggcggcuucgcagaagcaccccuacuccaacaagccguucaagccgcuuucggcgaccaaugcagaaucauaaucccacaagacguaggacucaccauucucaaaggcgccguacuuuucggccucgacccagccgucauuaaagugcgaagauccccucugacauacggcgucggaguccuaaaccgcuacgucgaaggaaaacacccacccgaaaaacuucuagucaaagacggcacccgauggugcaccgacguauucgauaaauucauaucagcagaccaaagcgucgcccucggcgagcuagucaaaagauccuacacacccgccaaaccaagccaacucgucaucguuaucaacauauacuccagcgaacacgacaacguaucguucauaaccgaccccgggguaaagaaaugcggcacccuccgccucgaccuaacaggcaccucaggcaccgccgucccagcacgcagagaaauacaaacccucaugcaguucggugacaccgaaaucaaagccaccgccaucgacauagcaaccaguaaaucggucaaaguaggcauagacuuucuaaacuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3577 - RNA, 2443 nt, Artificial Sequence
  mRNA product Design2 comprising derived and/or modified sequence from Homo sapiens__NP_443202.3 __HsHSPA12B (opt11)
ggggcgcugccuacggagguggcagccaucuccuucucggcaucaagcuuaccaugcuagccgucccagaaaugggcuuacaaggacuuuacaucggaagcuccccagaacgaucacccguacccagcccacccggaucaccccgcacccaggaaucaugcggaaucgcgccccugacacccagccaaagcccaaaacccgaaguacgggccccgcaacaagccuccuucagcguagucguggccauagacuucggaacgaccagcaguggcuacgcauucucauucgcaagcgauccagaggccauacacaugaugcgaaaaugggaaggcggcgacccaggaguagcacaccagaaaaccccaacaugccuacuccuaacccccgaaggcgccuuccacucauucggcuacacugcaagagauuacuaccacgaccucgacccggaagaagcccgcgacuggcucuacuucgagaaauucaagaugaaaauccacagcgccacagaccuaacacugaaaacccaacucgaggcggugaacggcaagacaaugccagcacucgaaguauucgcacacgcccuccgauucuuccgcgaacacgcacuacaagaacuacgcgaacaaagccccagucugcccgagaaggacaccguccgguggguguuaaccguacccgcaaucuggaaacaaccagcaaaacaauucaugcgcgaagccgccuacuuagccggacuuguaagcagagagaacgcagaacaacuccucauagcccuggaacccgaagccgccuccguauacugccgaaaacuacgacuacaccaacuacuagaccugucgggccgcgcccccggcggcggccgccuaggcgaaagacgaagcauagacuccuccuuccgccaagcccgagaacaacuaagaagauccagacacucacgaaccuuccuaguagaauccggagucggagaacuaugggccgaaaugcaagccggcgaccgcuacguagucgccgacugcggagggggcacugucgaccuuaccguacaccaacuagaacaaccacauggcacccuaaaagaacuauacaaagccucgggaggucccuacggggcugucggcguagaccucgcauucgagcaacuccuaugccgcaucuucggagaagacuucaucgcaacauucaaacgccaaaggcccgccgcaugggucgaccucacuaucgccuucgaagcacgaaaacgaacagcaggaccccaucgcgcaggcgcccucaacaucucacuacccuuuuccuucauagacuuuuacagaaaacaaagagggcacaacguagagacagcacucagacgauccagcgugaacuucguaaaauggucaucccaagggaugcugcgaaugucaugcgaagcaaugaacgagcuauuccaaccaacaguaucaggcauaauccaacacaucgaagcacugcucgcccgaccagaaguacaaggcguaaagcuccucuuccuagucggcggauucgccgaaagcgcaguccuccaacaugccguccaagccgcccugggcgcacgcggacuacgagucgucguaccacacgacgucggacucacgauacucaaaggagccguacuauucggacaagccccaggaguaguccgcguccgccguucgccgcucaccuacggcgucggcguccucaacagauucguaccaggacgccaucccccagaaaaacugcugguccgcgacggccgcagaugguguacagacgucuucgaacgcuucguagcagccgagcaauccgucgcgcuaggagaggaaguccgccguucauacugucccgccagacccggccaacgaagaguacucaucaaccuauacugcugcgcagcagaagacgcacgcuucauaacugacccaggcguccggaaaugcggcgcccucucacuagaacucgaacccgccgacugcggacaggacaccgcaggagccccacccggacgacgcgaaauucgggccgccaugcaauucggcgacaccgaaaucaaggugacagccguggacgucagcacgaaccgcagcguuagagcaagcauagacuuccucucaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3578 - RNA, 1798 nt, Artificial Sequence
  mRNA product Design2 comprising derived and/or modified sequence from Homo sapiens__NP_008879.3__HsHSPA13 (opt11)
ggggcgcugccuacggagguggcagccaucuccuucucggcaucaagcuuaccauggcccgcgaaaugaccauccucggcucagccguccuuacccuacuacuagcgggauaccuagcccaacaauaccuuccacuacccacccccaaagucauagguauagaccucggaaccaccuacugcuccgucggcgucuucuuucccggaaccggaaaagucaaagucaucccagacgaaaacggacacaucucuauccccucgauggucagcuucacagacaacgacguauacgucggcuacgaauccgucgagcuagccgacagcaacccacaaaacacaaucuacgacgccaaacgcuucaucggcaaaaucuucaccgccgaagaacucgaagccgaaaucggacgcuaccccuucaaaguacucaacaaaaacggcauggucgaguucucaguaaccagcaacgaaaccauaaccguaucccccgaauacgucggcucacgcuuacuacuaaaacucaaagagauggcagaggcuuaccucggcaugccggucgccaacgcugucauaagcguccccgcggaguucgaccucaaacaacgcaacuccaccauugaagcagcgaaccuggcaggacuaaaaauccuccggguaauaaacgaacccacagcagcagccauggccuacggacuccauaaagccgacgucuuucacguucuagucaucgacuuaggcggaggcacccucgacgucucccuccucaacaaacagggcggaauguuccuaacacgcgccaugucaggcaacaacaaacucggcggccaggacuucaaccaacgccuacuucaauaccucuacaaacagaucuaccagaccuauggauucguacccucucggaaagaagaaauccaccgccuccgccaagccguagaaaugguuaaacucaaccucacccuacaccagucagcgcaacuauccguccuccucacggucgaagaacaagaccgcaaagaaccccacucaucagacaccgaacuccccaaagacaaacucuccucagccgacgaccaccgcgugaacucaggcuucggccgcggccuauccgacaagaaauccggcgaaucucaaguacucuucgagacagaaauaagccgcaaacucuucgacacccuaaacgaagaccucuuccagaaaauacucguacccauccaacaaguccuaaaagaaggccaccuugagaaaaccgaaaucgacgaagucguucucgucggcggcuccacccgcaucccccguauucgacaagucauacaagaauuuuucggaaaagaucccaacacuagcgucgaccccgaccuugcaguagucacagggguagccauccaagccggaauagacggcggauccuggccccuucaagucuccgcacucgaaauccccaacaaacaccuucagaaaaccaacuucaacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3579 - RNA, 1912 nt, Artificial Sequence
  mRNA product Design2 comprising derived and/or modified sequence from Homo sapiens__NP_057383.2__HsHSPA14 (opt11)
ggggcgcugccuacggagguggcagccaucuccuucucggcaucaagcuuaccauggccgccaucggaguccaccucggcugcacauccgccugcguggccgucuacaaagacggacgcgcaggcguagucgccaacgacgccggagaccgcgucacccccgccguagucgccuacagcgaaaacgaggaaauagucggacucgccgccaaacaaucccgaauacgcaacauauccaacacaguaaugaaagucaaacaaauccucggacgaagcagcagcgacccacaagcccaaaaauacaucgccgaauccaaaugccuugucaucgagaaaaacggaaaacuacgauacgaaaucgacacaggggaagaaaccaaguucgucaacccagaggacgucgcacgccucaucuucagcaaaaugaaggagaccgcacauagcguacuaggguccgacgccaacgacgucguaauaaccgucccauuugacuucggcgaaaaacaaaagaacgcacuaggcgaagccgcccgcgccgcuggcuucaacguccugcgacuaauacacgaaccaucagcagcacuacuagccuacggcaucggacaagacucaccaacaggcaaaucaaacauacucguauucaaacucggaggcacuagccuaucacuauccguaauggaggugaacagcggcaucuaccgcguacucaguaccaacacagaugacaacauaggcggcgcccacuucacagaaacccuagcgcaauaccuagcgucggaauuucaacgcagcuucaaacacgacgucagaggaaacgcccgcgcgaugaugaaacuaaccaacagcgcggaagucgcaaaacacucccucucaacccucggcuccgccaacugcuuccucgacucacucuacgaaggccaggacuucgacugcaacgucucaagagcccgcuucgaacuccugugcuccccacuauuuaacaaauguaucgaagcaauacgcggacuccuagaccaaaacggcuucacagccgacgacaucaacaaagucguccucugcggcggcagcucgcgcauccccaaacuccaacaacuaaucaaagaccucuucccagccgucgaacuacucaacucgaucccacccgaugaaguuauucccauuggagccgccaucgaagccggcauccuaaucggcaaagaaaaccuacugguagaagacucacuaaugaucgaaugcucagcccgcgacauccucgucaaaggagucgacgaaagcggagccucccgauucaccguacuauucccuuccggaacgccgcucccagcccgccgacaacacacccuccaagcccccggcuccaucuccuccgucugccucgaacucuacgaaagugauggcaaaaacucagccaaagaagaaaccaaauucgcgcaaguaguacuacaagaccucgacaagaaagaaaacggacuacgcgacauccuagccguacucaccaugaaacgcgacggaucacuccacguaaccugcacagaccaagaaacaggcaaaugcgaagcuaucuccauagaaaucgccucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3580 - RNA, 2959 nt, Artificial Sequence
  mRNA product Design2 comprising derived and/or modified sequence from Homo sapiens__NP_006635.2 __HsHSPH1 (opt11)
ggggcgcugccuacggagguggcagccaucuccuucucggcaucaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgccaaaaaccaacaaauaacccaugcaaacaacaccgucagcaacuucaaacgauuccacggacgugccuucaacgaccccuuuauacaaaaagaaaaagaaaaccuauccuacgaccuagucccccucaagaauggaggcgugggcaucaaaguuauguauaugggagaagaacaccuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgccugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaaguccuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgccuauaccaggaaugcgaaaagcuaaagaaacugauguccuccaacuccaccgaccuaccccuaaacaucgaauguuucaugaacgacaaggacgucagcggaaagaugaacagaucccaguucgaggagcucugcgccgagcuacuccaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccauccuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacagaaagauggcgagaaaagccgcguaaaggucaaaguccgagucaacacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuacuaaacauguacaucgaaaccgaaggcaaaaugauaaugcaagauaaacucgaaaaagaacgcaacgacgccaaaaacgcagucgaagaauacguauacgaguuccgggacaaacuaugcggcccauacgaaaaauucaucugugaacaagaccaccaaaacuuucuacgucuauuaaccgaaaccgaagacuggcucuacgaagaaggcgaagaccaagcaaaacaggcuuacgucgauaaacuggaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacugaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3581 - RNA, 3382 nt, Artificial Sequence
  mRNA product Design2 comprising derived and/or modified sequence from Homo sapiens__NP_006380.1 __HsHYOU1 (opt11)
ggggcgcugccuacggagguggcagccaucuccuucucggcaucaagcuuaccauggcagacaaggucaggcggcaacgaccacggaggcgcguauguugggcgcuagucgcaguccuacuugcggaccuacuggcacuaagcgacacgcuggcaguuauguccguagaccucggaagcgaaucgaugaaagucgcgaucgucaaacccggcgucccaauggaaauaguccuaaacaaggaaagccgcaggaagaccccggugauagugacacucaaagagaacgaacgcuucuucggagacucggccgcgagcauggccauaaagaaccccaaagcaacgcuaagauacuuccaacaccuccucgggaaacaagcagacaacccacacguggcacucuaccaggcaagguucccagaacacgagcugacauucgacccgcaacgccaaacgguacacuuccaaauaucaucacaacugcaauuuucacccgaagaaguccuaggaauggugcucaacuacuccagaucauuagccgaagauuucgccgaacaaccaauaaaagacgcagucauaacaguacccgucuucuucaaccaggcagaacgccgagcaguccuacaagccgcgaggauggcaggccuuaaaguccuccaacugaucaacgacaacaccgcaacagcacugagcuauggcgucuucagacggaaggacauaaacaccaccgcacagaauauaauguuuuacgacaugggaagcggauccacagugugcaccauaguaaccuaccaaauggugaaaacgaaggaggccggcaugcaaccucagcuccaaauccgagggguaggauucgaccggacacucggcgggcuagaaauggaacuacggcuaagagaaagauuagcgggacuguucaacgaacagcgaaaaggacaacgagcgaaagacgucagggaaaacccccgcgcgauggcaaagcuccuucgagaggcaaaccgccugaaaacagugcugucagcgaacgcggaccacauggcucaaauagaaggacucauggacgacgucgacuucaaagcaaagguaacacgagucgaauuugaagaacuaugcgcggaucuauucgaaagagugcccggacccguacagcaagcacugcaguccgccgaaaugucccuagaugaaauagaacaaguuauccuagucggcggcgccaccagaguaccacgagugcaggaaguacuacucaaagccguaggcaaggaggaacuagggaaaaacauaaacgccgacgaagcagcagcgaugggggcaguuuaccaagccgccgcacucagcaaggcauucaaagucaaacccuucgucguacgagacgccgucguauacccgauacugguagaguucacacgcgaaguggaggaggaaccaggaauacauagccugaaacacaacaagcgaguucucuucagccgaaugggccccuacccccaaagaaaagugaucaccuucaaccgguacagccacgacuucaacuuccacauaaacuacggcgaccucggauucuuggggcccgaagaccucaggguauucgggagccaaaaccugacaacagucaaacucaaaggcguaggcgacagcuucaaaaaguacccagauuacgaaaguaaaggcauaaaagcacacuucaaucuugacgaaagcggagugcucucgcucgaccgcguggagagcgucuuugaaacccuaguagaggacagcgccgaagaagaaagcacgcuaacaaagcugggaaacaccauauccucacuauucggagggggaacgacaccagacgcaaaagagaacggaaccgacaccguccaagaagaggaagagagcccagcugaaggguccaaagacgagccaggagaacaaguugaacuuaaagaagaagcggaggccccuguugaggacggaagccaaccgcccccacccgaacccaaaggcgacgccacaccagaaggcgaaaaggcaaccgagaaggaaaacggagacaaauccgaagcccaaaaaccaagcgaaaaagcagaggccggcccagaaggggucgcgcccgcaccggaaggggagaagaagcaaaaacccgcacgaaaacgcagaaugguggaagaaaucggaguagagcuagucguacuagaccuaccagaucugccggaagacaaacuagcacaaucaguucagaaacuucaagacuugacccuacgggaccuggaaaaacaagaaagagaaaaagcagccaacagucucgaagccuucaucuucgagacacaagacaaacuguaccaacccgaguaccaggaaguaagcacagaagaacagagagaagaaaucaguggaaaacugagcgcugcgucaacauggcuagaagacgaagggguaggugcaacaaccgucaugcuuaaagaaaagcucgccgaacugcgcaaacucugccaagggcuauucuuccgaguagaagagaggaagaaauggccagaaaggcuauccgcacuagacaaccuacugaaccacucgagcauguuccuaaagggagcaagacucauaccagagauggaccaaauauucaccgagguggaaaugacaacacucgaaaagguaauaaacgaaacgugggccuggaaaaacgccacacuagcagagcaagccaaacugccagcaacagagaaaccaguacugcuaucaaaggacaucgaagcaaaaaugauggcacuggacagagaggugcaauaccuccucaacaaagcaaaauucacaaaacccagaccacgaccaaaagauaagaacggaacacgcgcagagccaccccuaaaugcuucggcgagcgaucaaggggagaaaguaauacccccagccgggcaaaccgaggacgccgagccgaucuccgaacccgaaaaggucgaaacaggcucagaacccggggauacagaaccacuugaacucggcggacccggagccgagccagaacagaaggaacaaaguacagggcaaaaacgcccccugaaaaacgacgaacuauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3582 - RNA, 2581 nt, Artificial Sequence
  mRNA product Design2 comprising derived and/or modified sequence from Homo sapiens__NP_005339.3 __HsHSP90AA1 (opt11)
ggggcgcugccuacggagguggcagccaucuccuucucggcaucaagcuuaccaugccagaagaaacccaaacacaagaucaaccaauggaagaagaagaaguggaaaccuucgcguuccaggcggaaauagcccaacuaaugucccucaucaucaacaccuucuacagcaacaaggaaaucuuccugcgagaacuuaucagcaacagcagcgacgcccucgauaagaucagauacgaaagccuaacugacccaagcaaacuagauagcgggaaagaacuccacaucaaccuaauacccaacaaacaagaccggacccucacaauaguagacaccggaaucggaaugacaaaggcggaccuuauaaacaaucugggaaccaucgcgaaaagcgggacaaaggcauucauggaagcgcuccaggcaggggcagacauaucaaugaucggccaauucggagucggcuucuacucagcguaccuaguagccgagaaaguaaccgucauaaccaaacacaacgacgaugagcaguacgcgugggagagcagcgcgggaggaucguucacagugagaaccgacacaggggaaccgaugggacgcggaacgaaaguaauacuacaccucaaagaagaccagaccgaauaccucgaagaaaggcgaauaaaagaaauagugaagaaacacucccaguucaucggauacccgauaacacuauucguggagaaagagcgcgacaaagaggucagcgacgacgaagcagaagaaaaagaagacaaagaagaggaaaaggaaaaagaagaaaaagaaagcgaagacaaaccagagaucgaagacgugggaagcgacgaagaagaagaaaagaaagauggagacaagaagaaaaagaagaaaaucaaagagaaauacauagaccaagaagaacuaaacaaaacgaaaccaaucuggacccggaacccagacgacauaaccaaugaagaauacggcgaguucuacaaaucacucacaaacgacugggaagaccaccucgccguaaaacacuucucgguagagggacaacuagaguuccgagcgcuccuguucgugccaaggcgagccccauuugaccuguucgagaauagaaagaagaaaaacaacauaaaacucuacguccgccgggucuucaucauggacaacugugaagaacuaauuccggaauaccugaacuucauccgcggcguaguggacagcgaagaccugccgcucaacaucucgagagaaauguuacaacaaagcaaaauccucaaaguaauaaggaagaaccucgugaagaaaugccuggaauuauucacagaacuagccgaagacaaagaaaacuacaagaaauucuacgagcaauucagcaaaaacauaaaacugggcauccacgaagacagccaaaaccgcaagaaacuauccgagcuccuacgcuacuacaccuccgcauccggggaugagauggugucacuaaaagacuacugcaccagaaugaaagaaaaccaaaaacacaucuacuacaucacgggcgaaacaaaagaccaaguagcgaacucagccuucgucgagcgccuacgaaaacacgggcuagaagucauauacaugaucgaaccaauagacgaauacugcguccaacaacucaaagaguucgaaggaaaaacccucgucagcguuaccaaagaaggcuuggagcuccccgaagacgaagaagagaaaaagaaacaagaagaaaagaaaaccaaauucgaaaaccugugcaaaaucaugaaggacauacuggaaaagaaaguagagaaggucguaguaucaaacaggcucgugaccagccccugcugcauagucacaucuaccuacggauggacggccaacauggaaagaauaaugaaggcccaagcacuccgcgacaacucgacaaugggcuacauggcggccaagaaacaccucgagaucaaccccgaccacuccaucaucgaaacgcucaggcagaaagccgaagcagacaaaaacgauaaauccgugaaggaccucguaauacuccuauaugaaacggcccuucuaagcagcggguucagccucgaagacccgcaaacgcacgcgaacaggaucuaccgaaugaucaaacucggccuugggaucgacgaagacgacccaacagcagacgacacgagcgcggccguaacggaagaaaugccaccacuagaaggcgacgacgacacgagcaggauggaggaaguggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3583 - RNA, 721 nt, Artificial Sequence
  mRNA product Design2 comprising derived and/or modified sequence from Homo sapiens__NG_005218__HsHSP90AA3P (opt11)
ggggcgcugccuacggagguggcagccaucuccuucucggcaucaagcuuaccauggacagcucaaaacuggacucgggcaagggccugcacauaaaccuggucccgaacaagcaaaaccaaacacucacgaucguggacacgcgcauaggcaugaccaagaccgaccucauaaacaaccucgggaccgugaccaagagcgggaccaaggccuucauggaggcccugcaagcggacgcggacauaagcaugaucggacacuucggcgugggcuucuacucggccuaccucguggccaagaaagugaccgugaucucaaaacacaacaacgacgagcaauacaccugggaaucgagcgcgggcgggagcuucaccgugcgcacggacgaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3584 - RNA, 2557 nt, Artificial Sequence
  mRNA product Design2 comprising derived and/or modified sequence from Homo sapiens__NP_031381.2__HsHSP90AB1 (opt11)
ggggcgcugccuacggagguggcagccaucuccuucucggcaucaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagagcgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagagcugaacaaaacaaaaccaaucuggaccaggaaccccgaugacaucacacaagaagaauacggggaauucuacaaaucgcuaacaaacgacugggaggaccaccucgcgguaaagcacuucagcguggaaggacaacucgaauucagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauucgacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuucgaaacagcccuacucucaagcggauuuucacuggaggacccacaaacccacagcaacagaaucuaccgaaugauuaagcucggacuggguauugacgaggacgaaguagccgcggaagagcccaacgcggcaguccccgacgaaaucccgccccuggaaggggacgaggacgcaucaagaauggaagaggucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3585 - RNA, 2794 nt, Artificial Sequence
  mRNA product Design2 comprising derived and/or modified sequence from Homo sapiens__NP_003290.1__HsHSP90B1 (opt11)
ggggcgcugccuacggagguggcagccaucuccuucucggcaucaagcuuaccaugagagcccuaugggugcucgggcucugcugcguacuacucacguucggaucaguccgagcagacgacgaggucgacgucgacggaacggucgaagaagaccuaggaaaaagccgcgaaggcagccggacagacgacgaggucguccagcgagaggaagaggcaauacaacucgacggucuaaacgccagccagauacgcgagcuccgggagaaaagugaaaaauucgccuuccaagcagaggucaacagaaugaugaaacucauaauuaacucccuauacaaaaacaaagaaauauuccugcgggaacuaaucuccaacgccagcgacgccuuagacaaaauacgacucaucagccugacagacgaaaacgccuugagcgggaacgaggaacuaaccgugaaaauaaaaugcgacaaagagaagaaccugcuacacguaacggauacgggaguaggcaugacacgagaagaacucgucaaaaaccucggaaccauagccaagagcggcacaagcgaguuccucaacaaaaugacagaagcccaggaggacggccaaucaacgagugagcuuauaggccaauucgggguaggguucuacagcgcguuccuaguagcggacaaaguaauagucacaagcaaacacaauaacgauacacagcacauaugggaaucagacagcaacgaauuuagcgugaucgcggacccgcggggaaacacgcuuggcagaggaaccaccaucacucuaguacucaaggaagaggcuucagacuaucuagaacuggacacaaucaaaaaccucguaaagaaauacagccaauucauaaacuucccgauauacgucuggagcucgaaaacagaaacaguagaggagccgauggaggaggaagaggcagccaaagaagaaaaagaagaaucggacgacgaagcggcagucgaagaagaagaggaagagaaaaagcccaaaaccaagaaaguagagaaaaccguaugggacugggaacucaugaacgacauaaaacccauauggcagcgcccgagcaaagaagucgaggaagacgaauacaaagccuucuacaagagcuucagcaaagaaagcgacgacccgauggccuauauacacuucacagccgaaggagaggugacguucaaaagcauccucuucgucccgacgagcgcccccaggggacucuucgacgaauacgggaguaagaaaagcgacuacaucaaacuauacguccgacggguguucauaaccgacgacuuccacgacaugaugcccaaguaccugaacuucgucaaaggagugguagauucagaugaccugccacucaacguaagcagagagacgcuccaacagcacaaacugcucaagguaauacgcaagaagcuagucaggaaaacgcucgacaugaucaaaaagauugcggacgauaaguacaacgacacguucuggaaggaguucggaacgaacauaaaacuaggcguaaucgaagaccacagcaaccgaacaagacucgcaaaacuccucagauuccagagcagccaucaccccacagacauaacaagccuggaccaauauguggaacgaaugaaagaaaaacaggacaaaaucuacuucauggcgggauccagccgcaaagaggcagaaagcagccccuucguagaacgacuccuaaagaaaggcuacgaagucaucuacuugaccgaaccaguagacgaauacugcauccaggcccuucccgaguucgacggcaagagauuccaaaacgucgcgaaggaaggcguaaaauucgacgaaagcgagaagacgaaagaaucgagggaagcagucgagaaagaguucgaaccacugcucaacuggaugaaagacaaagcgcuaaaagacaagauagaaaaagcgguaguaucgcaacggcugaccgaaagcccaugcgcccuagucgcgagccaauacggcuggagcgggaacauggaaagaauuaugaaagcgcaagccuaccagacaggaaaggacaucagcaccaacuacuacgccagccaaaagaagacguucgaaaucaacccaagacacccgcuaauaagagacaugcuacgaaggaucaaggaagacgaggacgacaagaccgugcucgaccucgcggucgugcuauucgaaacggccacgcuuagaagcggauaccugcuacccgacacgaaagccuacggcgaccgaaucgaacgcaugcuaaggcucagucuaaacauagaccccgacgcgaaaguggaagaggaaccagaggaggaaccagaagaaacggcagaggacaccaccgaggacacagaacaggacgaggacgaggagauggacgucggaacggacgaagaggaagaaaccgcaaaggaaucgaccgcagaaaaggacgagcuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3586 - RNA, 2497 nt, Artificial Sequence
  mRNA product Design2 comprising derived and/or modified sequence from Homo sapiens__NP_057376.2__HsTRAP1 (opt11)
ggggcgcugccuacggagguggcagccaucuccuucucggcaucaagcuuaccauggcccgcgaauuacgagcccuacuacuauggggucgccgacuccgcccacuacuccgagcccccgcacucgccgcagucccuggaggaaaacccauacucugcccccgaagaacaacagcucaacucggcccccgucgcaacccagccuggucgcuccaggccggccgacucuucuccacacaaaccgccgaagacaaagaagaaccccuccacagcauaaucagcagcaccgaguccguacaaggaagcaccuccaaacacgaguuccaggccgaaaccaagaaacuucucgacaucguagcccgaagucuauacuccgaaaaagaagucuucauccgagaacuuaucucuaacgcauccgacgcacucgaaaaacuacgacacaaacucguaucagacggucaagcacuacccgaaauggaaauacaucuacaaaccaacgcagaaaaagguaccauaacaauucaagacacgggaauaggaaugacgcaggaggaacucgucucaaaccuaggcacuauagcccgaagcggcagcaaagccuuccucgacgcccuccaaaaccaagccgaagccuccuccaaaaucaucggucaguucggcguaggcuucuauuccgccuucaugguagcagaccgagucgaaguauauucucgcucagcagcccccggcucccuaggcuaccaauggcuauccgacggcagcggcguguucgaaauagcagaagccucgggcguccguacaggcaccaaaaucaucauacaccuaaaaagcgacugcaaagaauuuagcucagaagcccgcguccgagacgucgucaccaaauauucaaauuucgucucauuuccacucuaucuaaacggcagacgcaugaacacgcuccaagccaucuggaugauggacccaaaagacguccgcgaauggcagcaugaagaguucuaccgcuacguagcacaagcgcacgacaaaccacgcuacacccuccacuacaaaacggacgccccacuaaacauccgcuccaucuucuacguaccggacaugaaacccagcauguucgacguaucccgcgaacucggcucaucgguagcacucuacucuaggaaaguccucauacaaacaaaagccaccgacauccuaccaaaauggcuucgauucaucagaggcgucgucgacagugaagacaucccccucaaccucucacgagaacuccuacaagaauccgccuuaauccgaaaacuccgcgacguacuucaacagcgucucauaaaauucuucaucgaucaauccaagaaagaugcagaaaaauacgccaaauucuucgaagacuacggccucuucaugcgggaaggcaucguaacagcaaccgagcaagaggucaaagaggacauagcaaaacuccucagauacgaguccagcgcccuucccucgggccaacuaacuagccuaagcgaauacgccucacguaugagagcaggcacccgcaacaucuacuaccucugcgccccaaaccgacaccucgcagaacacucacccuacuacgaggccaugaaaaagaaagacaccgaaguccuguucugcuuugaacaauucgacgaacugacccuacuacaccucagagaguucgacaaaaagaaacucaucagcgucgagacggacaucgucguagaccacuacaaagaagaaaaauucgaggaccgcagcccagccgcagaaugccuaucggaaaaagaaaccgaagaacucauggccuggaugcggaacguccuaggcuccagaguaaccaacguaaaagucacacucagacuagacacccaccccgccauggucaccguacuagaaaugggagcugcccgacacuuccuacgaaugcaacaacuagcaaaaacacaggaggaacgcgcccaacuccuucaaccaacccucgaaauaaacccccgacacgcccuaauaaagaaacuaaaucaacugagggccuccgagcccggacucgcccaacuucuagucgaccagaucuacgaaaacgccaugaucgcggcaggccuaguagacgacccccgcgccauggugggacgacuaaaugaacuacuugucaaagcacuagagcgacauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3587 - RNA, 844 nt, Artificial Sequence
  mRNA product Design2 comprising derived and/or modified sequence from Homo sapiens__NP_000609.1__HsIGF1 (opt11)
ggggcgcugccuacggagguggcagccaucuccuucucggcaucaagcuuaccaugggcaaaaucuccucccuccccacccaacucuucaaaugcugcuucugcgacuuccuaaaagucaaaaugcacaccauguccuccucccaccucuucuaccuagcccucugccuccuuaccuucaccuccuccgccaccgccggccccgaaacccucugcggcgccgaacucgucgacgcccuccaauuugucugcggcgaccgcggauucuacuucaacaaacccaccggcuacggcuccuccucccgccgcgcaccccaaaccggcaucgucgacgaaugcugcuuccgcuccugcgaccuccgccgccucgaaauguacugcgcaccccucaaacccgccaaauccgcccgcuccguccgcgcccaacgccacaccgacaugcccaaaacccaaaaagaaguccaccucaaaaacgccucccgcggcuccgccggcaacaaaaacuaccgcauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3588 - RNA, 925 nt, Artificial Sequence
  mRNA product Design2 comprising derived and/or modified sequence from Homo sapiens__NP_000603.1__HsIGF2 (opt11)
ggggcgcugccuacggagguggcagccaucuccuucucggcaucaagcuuaccaugggcauccccaugggcaaauccaugcucguccuccuaaccuuccucgccuucgccuccugcugcaucgccgccuaccgacccuccgaaacacucugcggcggcgaacucgucgacacccuccaauucgucugcggcgaccgcggcuucuacuucucccgccccgccucccgcgucucacgccgcucccgcggcaucgucgaagaaugcugcuuccgcucuugcgaccucgcccuccucgaaaccuacugcgccacccccgcaaaauccgaacgcgacgucuccaccccccccacaguacuccccgacaacuucccccguuaccccgucggcaaauucuuccaauacgacaccuggaaacaauccacccaacgccuccgccgcggacuacccgcccuacuccgcgcccgccgcggccacguccuagcaaaagaacucgaagccuuccgagaagccaaacgccaccgcccccucaucgcccuccccacccaagaccccgcccacggaggcgccccccccgaaauggccuccaaccgcaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3589 - RNA, 1021 nt, Artificial Sequence
  mRNA product Design2 comprising derived and/or modified sequence from Homo sapiens__NP_000591.1__HsIL6 (opt11)
ggggcgcugccuacggagguggcagccaucuccuucucggcaucaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauucgaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuccuccaauccucccuccgcgcccuccgacaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3590 - RNA, 1663 nt, Artificial Sequence
  mRNA product Design2 comprising derived and/or modified sequence from Homo sapiens__NP_002183.1__HsINHBA (opt11)
ggggcgcugccuacggagguggcagccaucuccuucucggcaucaagcuuaccaugccacuccuguggcuccgcggauuccuccuagcaagcugcuggauaauaguacgaagcuccccaacaccaggcagcgagggccacagcgccgcacccgacugcccauccugcgcacucgccgcccucccaaaagacgucccgaacagccaacccgaaauggucgaagcggucaagaaacacauacucaacaugcuacaccuaaagaaacgcccagacguaacacagccaguccccaaagccgcacuacuaaacgcgauccgaaaacuacacguaggcaaagugggagaaaauggcuacgucgaaaucgaagacgacauaggcagacgagcagaaaugaacgaacuaauggaacaaacaagugaaauaaucacauucgccgagagcggcacagcccggaaaacccuacacuucgaaaucucaaaagaaggauccgaccucagcgucguagaacgagccgaaguguggcuauuccucaaaguccccaaagccaacagaaccagaaccaaagucacaaucagacucuuccaacagcaaaaacacccgcaaggaagccucgacacaggcgaagaagcagaggaagucggacucaaaggugaacgcagcgaacuccuccuguccgaaaaagucgucgacgcccgaaaaagcacauggcacguauucccaguaagcagcuccauccaacgccugcuagaccaagggaaaucaagccuggacguccgcauagcaugcgaacaaugccaagaaagcggcgcaagccuaguacuacuagggaaaaagaaaaagaaagaggaagaaggagaaggaaagaagaaaggaggcggagaagguggagcaggcgccgacgaagaaaaagaacaaagccaccggccauuccucaugcuacaagccagacaaagcgaagaccacccacaccgacgacgccgacgaggccucgaaugcgacggaaaagucaauauaugcugcaagaaacaauucuucgucagcuucaaagacauaggguggaacgacuggaucauagccccaagcggcuaccacgccaacuacugcgaaggagaaugcccaagccacaucgccggaacauccgggagcagccugagcuuccacagcacgguaauaaaccacuaccgcaugcgcggccacagcccauucgccaaccucaaaagcugcugcguacccaccaaacuacgcccaauguccaugcucuacuacgacgacgggcagaacaucauaaagaaagacauacagaacaugaucgucgaagagugcggcugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3591 - RNA, 1606 nt, Artificial Sequence
  mRNA product Design2 comprising derived and/or modified sequence from Homo sapiens__NP_002184.2__HsINHBB (opt11)
ggggcgcugccuacggagguggcagccaucuccuucucggcaucaagcuuaccauggacggccuaccaggacgagcccucggcgccgcaugccuccuucuccucgccgccggaugguuaggccccgaagcauggggcucacccaccccaccacccaccccagccgcacccccacccccacccccaccaggauccccaggaggcagccaagacacaugcaccucgugcggaggcuucagacgcccugaagaacuaggccgagucgacggcgacuuccucgaagccgugaaacgccauauacucucccgacuccaaaugcgcggccgacccaacauaacccacgccguacccaaagcagcuaugguaaccgcccuccgcaaacuccaugccggcaaaguccgagaagacggccgagucgaaaucccccaccucgacggacacgccucccccggcgccgacggccaagaacgaguaucagaaaucaucuccuucgcugaaaccgacggccuggcauccucccgaguccgccucuacuucuuuauauccaacgaagguaaccaaaaccucuucgucguccaagccucacuauggcucuaccuaaaacuacuccccuacguacucgaaaaaggcagccgccgcaaaguccgcguaaaagucuauuuccaagaacaaggccacggcgaccgcuggaacaugguagaaaaacgugucgaccucaaaagaucaggcuggcacaccuucccccuaaccgaagcuauccaagcacucuucgaacgaggagaacgaagacucaaccucgacguacaaugcgacucuugccaagaacucgcgguagucccaguauucgucgaccccggcgaagaaucccacagacccuuuguaguaguacaagcgcgacucggcgacucucgacaccgaauccgcaaacgcggccuagaaugcgacggacgcacaaaccucugcugccgccaacaauucuucauagacuuccgccuaaucggcuggaacgacuggaucauagcccccaccggcuacuacggcaauuacugcgaaggcucaugccccgcauaccucgccggcguccccggcucagcauccucuuuccacaccgccgucguaaaccaauacaggaugcgcggacuuaacccaggaacagucaauuccugcugcauacccaccaaacucagcaccauguccaugcucuacuucgacgacgaauacaacaucgucaaacgcgacguccccaacaugaucgucgaagaaugcggaugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3592 - RNA, 3841 nt, Artificial Sequence
  mRNA product Design2 comprising derived and/or modified sequence from Homo sapiens__NP_000623.2__HsITGAM (opt11)
ggggcgcugccuacggagguggcagccaucuccuucucggcaucaagcuuaccauggcccuccguguuuuacugcucacagcacucacacugugucacggauucaaccuagacaccgaaaaugcaaugaccuuccaagaaaacgcacgcggcuucggacaaucgguaguccaacuacaagguucgcgcguagucgucggcgccccucaagagauagucgcugcaaaccaacgaggcucacucuaccaaugcgacuacucaaccgggucaugcgaaccaaucagacuccaagucccagucgaagcagucaacaugagccugggucucagccucgccgccacaaccucacccccacaacucuuagcaugcggaccaaccguccaucagaccugcucggaaaacaccuacguaaaaggccuaugcuuucucuuuggguccaaccuacgacagcagccccaaaaauuccccgaagcccuccgaggauguccgcaagaagacagcgacauagccuuucucauugacggcuccggauccauaauaccacacgacuuccgccggaugaaggaauuugucucaacaguuauggaacaacucaagaaauccaaaacacucuucucccugaugcaauacagcgaggaguucagaauccacuucaccuucaaagaguuccagaacaaccccaacccccgcucacugguaaaaccaauaacucaacuccucggcaggacacacacggccacgggcaucaggaaggucgugcgcgaacucuucaacauaacaaauggugcacgcaaaaacgccuucaaaauccuuguggucauaaccgacggcgaaaaauucggggacccauuaggauacgaagacguaauccccgaagcggacagagagggaguaauccgauacgucaucggcguuggggacgccuuccguagcgaaaaaucccgccaggaacucaacacaauugccuccaaaccgccccgagaccacgucuuccaagucaacaacuucgaagcccucaaaaccauccaaaaccaacuccgagagaaaauauucgccauagaaggaacccaaaccggcagcuccagcuccuucgaacaugaaaugucccaagaaggcuucagcgccgcgaucaccuccaacggcccucuacucucuaccgucggaucauacgacugggcuggcggcgucuuccuuuacaccuccaaggaaaaaucgacauucaucaacaugaccagagucgauucugacaugaacgacgcauaucucggcuacgccgcugcuaucauucuacgcaacagagugcaaucucuaguauuaggagccccucguuaccaacacaucggccuaguggcaauguuccgucaaaacaccgggaugugggaaagcaacgcgaacgucaagggcacccaaaucggcgcauacuucggagcuucucucugcucuguggacgucgacucaaacggaagcacugaucucguucuuaucggagcaccccacuacuaugagcagacucgaggaggccaaguaucagucuguccacucccccguggccgagcccgcuggcaaugcgacgcgguucuauauggcgaacaaggucaacccuggggcagguucggugccgcgcucaccguccuuggagacgucaacggcgacaaacucaccgacguagcaaucggcgcaccuggcgaggaagacaaccgcggcgcaguguaccucuuccacggcaccuccggcagcggcaucucacccucccacucacaacgcauagccggcucuaaacugucccccagacugcaauacuucgggcaaagccuauccgguggacaagaccucacgauggacggccuaguagaucugacgguuggcgcgcaagggcauguacuucuacuacgaucccaaccaguacuacgugucaaggcaaucauggaguucaauccacgggaagucgcacgaaacgucuucgaaugcaacgaccaaguugucaagggcaaagaagccggcgaagucagagugugucugcacguacaaaagagcacacgugaucgacugcgagaaggacaaauccaguccguggucaccuacgaccuagcccuagacuccggaagaccccacagccgugccgucuucaacgaaaccaaaaauucaacccgccggcaaacccaggugcuaggccuuacccaaacuugcgagacgcucaaacuacaacugcccaacuguaucgaagacccagucucaccaaucguacuacgccuuaauuuuucccuagucggcacaccccucucagcauucggaaaccuccgacccguccucgccgaagacgcccaacgacuuuucaccgcccuauuccccuucgaaaagaacugcggcaacgacaacauaugucaagacgaccucagcaucaccuucucuuucaugucgcucgacugccuagugguaggcggaccccgagaauuuaacgucacagucaccguaagaaacgacggagaggauuccuacagaacgcaaguuacauucuucuucccgcucgaccucucguaccgcaaagucucgacccuucaaaaccaacgaucucaacgaucuuggaggcucgcaugugaaucagccucgucaacagaaguaaguggcgcccucaaaucgaccuccuguuccauaaaccacccaaucuuccccgagaacagcgaagucacauucaacauaacauucgacguugacucuaaagcaucacucggcaacaaacucuuacugaaagccaacgucaccagcgaaaacaacaugccaagaacaaacaaaacagaguuccaacucgaacucccagucaaguaugccguauacauggucgucaccagccacggaguauccacaaaauaccucaacuuuaccgccagcgaaaacacguccagaguaaugcaacaccaauaccagguauccaaccuuggucaacgcagucuacccaucucccuaguguuccucguucccgucagacuaaaccagacaguaauaugggaccguccacaaguaacauucucugaaaaccucuccuccacaugucacacuaaagaacgacucccuagccauuccgacuuucuugcagagcuucgcaaagccccuguugugaacugcucaaucgcgguaugccagcgcauacagugcgacauaccauucuuugggauacaggaagaguucaacgcgacucucaaagguaaccucagcuucgacugguauaucaagaccucacauaaccaccuccuaauaguauccacagccgaaauccucuucaacgacagcgucuucacauugcugcccggccaaggagcuuucguacgaucgcagacagaaacuaaaguagaaccuuucgaagucccgaacccgcucccgcuaaucgucggauccuccguuggcgggcuacuccuucuugcccucaucacagcagcacuguauaagcucggcuucuucaagcgccaauacaaagauaugauguccgaaggcggcccgcccggggccgaaccccaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3593 - RNA, 1786 nt, Artificial Sequence
  mRNA product Design2 comprising derived and/or modified sequence from Homo sapiens__NP_002415.1__HsMMP8 (opt11)
ggggcgcugccuacggagguggcagccaucuccuucucggcaucaagcuuaccauguucucccucaaaaccuuaccguuccuccuacuacuacacguccaaaucuccaaagccuucccugucuccagcaaagagaaaaacacuaaaaccguacaggacuaccucgaaaaauucuaccaacuacccucaaaccaguaccaguccacccgcaaaaacggcacaaacgugaucgucgaaaagcuaaaagaaaugcaacgcuucuucggccuaaacgucacaggcaaacccaacgaagaaacccucgacaugaugaagaaaccccgaugcggcguccccgacuccggcggcuucaugcucacacccgguaaccccaaaugggaacgaaccaaccuaaccuaccgcauacgaaacuacacaccccaacucucagaagccgaagucgaacgagcuaucaaagacgcauuugaacucugguccgucgcaucaccccucaucuucacccgcaucucucaaggcgaagccgacauaaauaucgccuucuaucaaagagaccacggcgacaacucccccuucgacggcccgaacgguauccucgcacacgccuuccaaccaggccaaggaaucggcggcgaugcccacuucgacgcagaagaaaccuggacaaacaccucagccaacuacaaccucuuccucgucgccgcgcacgaguucggacauucccucggccuagcccacuccuccgaccccggugcacucauguacccaaacuacgccuuccgcgaaaccagcaacuacucacucccccaagacgacauagacggcauccaagccauauacggacuaucauccaaccccauccagccaaccggacccucaacccccaaacccugcgauccaucccucaccuucgacgccaucaccacccuacguggagagauccucuucuucaaagaucgauauuucuggcgccgacacccccaacugcaacggguugaaaugaacuucaucagccucuucuggccuucacuacccaccggaauccaagccgccuaugaagacuuugaccgcgaccucaucuuccucuucaaaggaaaccaauacugggcccucucggguuacgacauccuucaaggcuacccuaaagacauaucaaacuacggauucccaucguccguccaagccaucgaugccgcaguuuucuaccgcuccaaaaccuacuucuucgucaacgaccaauucuggcgcuaugacaaccaacgccaauucauggaaccaggauaccccaaauccaucuccggcgccuuccccggcaucgaaagcaaagucgacgcagucuuccaacaagaacacuucuuccacguuuucucaggcccucgcuacuacgccuucgaccuaaucgcccaacgagucacccgagucgcccgaggaaacaaauggcuuaacugccgcuacggauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3594 - RNA, 2506 nt, Artificial Sequence
  mRNA product Design2 comprising derived and/or modified sequence from Homo sapiens__NP_004985.2__HsMMP9 (opt11)
ggggcgcugccuacggagguggcagccaucuccuucucggcaucaagcuuaccaugucccucuggcaaccucucguauuaguacuccuaguccuuggaugcugcuuugccgcuccucgacaacgccaauccacacucguccuuuucccaggggaucuaagaaccaaccuuaccgaccggcaacuagcagaggaauaccuauaccgcuauggauacacaagagucgccgaaaugagaggagaaucgaaaagccucggaccagcccuccuacuacuacaaaaacaacucucccugcccgaaacuggcgaacucgacucugccacucuaaaagcaaugaggaccccacgaugcggcguccccgaccuaggcagauuccaaaccuucgaaggcgaucuaaaauggcaccaccacaacauaaccuacuggauccaaaacuacucagaagaccucccccgagccguaauagacgaugccuucgcaagagcuuucgcccucuggucggcagucacuccccucaccuuuaccagaguauacucccgagacgccgacauagucauccaauucggcgucgccgaacacggcgacggcuaccccuucgacggaaaagauggacuccucgcucacgcguucccaccaggcccagguauccaaggcgaugcucacuucgacgacgacgaacuauggucucucggaaaaggggucgucguccccacccgauucggaaacgcagacggcgccgcuugccacuuccccuucaucuucgaaggacguuccuacagcgccugcacgaccgacggaagauccgauggacuaccauggugcucaacgaccgccaacuacgacacagacgacagauucggauucugucccucagaacgucucuacacacaagacggcaacgccgauggcaaacccugccaauuccccuucauauuccaaggccaauccuacuccgccugcacaaccgacggacgcucugacggcuaccgauggugcgcuacaacagcaaacuaugaucgagacaaguuauuuggauucugccccacccgcgccgauuccaccguaaugggugggaacuccgcaggagaacucugcgucuuccccuucaccuuccucggaaaagaguacagcacaugcaccuccgaaggccgaggcgacggccgccuauggugcgccaccaccuccaacuuugacucagacaagaaaugggguuucugccccgaccaagguuacagccucuuccucgucgccgcacaugaauuuggacacgcauuaggccuagaccacucgucaguccccgaagcccucauguaccccauguacagauucacugaaggcccaccccuccacaaagacgacgucaacggaauccgccaucucuacggcccccgaccagaaccugaaccacgcccacccacaaccaccacaccccaacccaccgccccacccacugucugccccaccggcccacccaccguccaucccagcgagagacccaccgcgggcccaaccggcccacccuccgcaggccccacuggacccccaaccgcaggacccuccaccgcuacuaccguuccacuauccccagucgacgacgcuugcaacgucaacaucuucgacgccauagcugagauaggaaaccagcucuaccuauucaaagacggaaaauacuggcgauucuccgagggacgcggcucccgcccccaaggaccauuucuaauagcagacaaguggcccgcacucccacgcaaacuugacuccguuuucgaggaaagacucuccaagaaacuauucuucuuuuccggccgacaagucuggguuuacacaggcgccuccguacucgguccucgccgccuugacaaacuagggcucggcgcagacgucgcccagguaacaggagcucuccgaagcggaaggggcaaaauguuacucuucuccggccgucgacucuggcgauucgacguaaaagcccaaaugguagaucccagaagcgccagcgaagucgaccgcauguucccaggagucccccuugauacccacgacgucuuccaauaccgcgaaaaagccuacuuuugccaagaccgcuucuacuggcgcgucucuagcagaucagaacuuaaccaaguagaccaaguaggcuacgucaccuacgacauccuacagugcccagaagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3595 - RNA, 1798 nt, Artificial Sequence
  mRNA product Design2 comprising derived and/or modified sequence from Homo sapiens__NP_002418.1__HsMMP13 (opt11)
ggggcgcugccuacggagguggcagccaucuccuucucggcaucaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauucggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3596 - RNA, 1450 nt, Artificial Sequence
  mRNA product Design2 comprising derived and/or modified sequence from Homo sapiens__NP_001286.1__HsCCR1 (opt11)
ggggcgcugccuacggagguggcagccaucuccuucucggcaucaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuaccuacucaaccuugccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccuccuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaaucccuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgacuagaacgcgucuccuccacaagcccaagcaccggcgaacacgaacucuccgccggcuucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3597 - RNA, 1018 nt, Artificial Sequence
  mRNA product Design2 comprising derived and/or modified sequence from Homo sapiens__NP_002598.4__HsPDGFA (opt11)
ggggcgcugccuacggagguggcagccaucuccuucucggcaucaagcuuaccaugcgcacacucgccugccuccuacuccucggcugcggcuaccucgcacacguccucgccgaagaagccgaaaucccccgagaagucaucgaacgacucgcccgcucccaaauccacuccauccgcgaccuccaacgccuccucgaaaucgacuccgucggcuccgaagacucccucgacaccucacuccgcgcccacggaguccacgccaccaaacacguacccgaaaaacgaccccuccccauccgccgaaaacgcuccauagaagaagccguccccgccgucugcaaaacccgcaccgucaucuacgaaaucccccgcucccaagucgaccccacauccgccaacuuccucaucuggccccccugcguagaagucaaacgcugcaccggcugcugcaacacauccuccguaaaaugccaacccucccgcguacaccaccgcuccgucaaagucgccaaagucgaauacguccgcaaaaaacccaaacuaaaagaaguccagguccgccucgaagaacaccucgaaugcgccugcgccaccaccucccucaacccagacuaccgcgaagaagacaccggccgcccccgcgaauccggcaaaaaacgcaaacgcaaacgccugaaacccaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3598 - RNA, 1108 nt, Artificial Sequence
  mRNA product Design2 comprising derived and/or modified sequence from Homo sapiens__NP_002599.1__HsPDGFB (opt11)
ggggcgcugccuacggagguggcagccaucuccuucucggcaucaagcuuaccaugaaccgaugcugggcccucuuccucagccucugcugcuaccuacgacuuguaucagccgaaggcgacccaaucccagaagaacuauacgaaaugcuguccgaccacuccauccgcuccuucgacgaccuccaacgccuccuccacggugaccccggcgaagaagacggcgccgaacuagaccuuaauaugacccgcucccacuccggcggagaacucgaaucacucgcccgcggacgccgcucccuaggcucccucaccaucgccgaaccagccaugaucgccgaaugcaaaacacgcaccgaaguauucgaaaucucacgccgacucaucgaccgcaccaacgccaacuuccuugucuggcccccaugcgucgaaguccaacgcugcuccggcugcugcaacaaccgcaacguacaaugccgacccacacaaguacaacuccgcccaguccaaguacgcaaaaucgaaaucguccgcaaaaaaccaaucuucaaaaaagccacagucacccucgaagaccaccucgccugcaaaugcgaaaccguagccgccgcacgccccgucacccgcucacccggcggaucacaagaacaacgugcaaaaaccccccaaacccgcgucacaauccgcaccguccgcguccgccgcccccccaaaggaaaacaccgcaaauucaaacacacacacgacaaaaccgcccucaaagaaacccuaggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3599 - RNA, 1420 nt, Artificial Sequence
  mRNA product Design2 comprising derived and/or modified sequence from Homo sapiens__NP_057289.1__HsPDGFC (opt11)
ggggcgcugccuacggagguggcagccaucuccuucucggcaucaagcuuaccaugagccucuucggccuccuccuccucaccuccgcccuggccggccagcgccaaggcacccaggccgaauccaaccucuccuccaaauuccaauucuccuccaacaaagaacaaaacggcguccaagacccccaacacgaacgaaucaucaccgucucaacaaacggcucaauacacucaccacgcuucccccacaccuacccaagaaacaccguccucgucuggcgccuagucgccgucgaagaaaacguauggauccaacucaccuucgacgaacgcuucggccucgaagacccagaagacgacaucugcaaauacgacuucguagaagucgaagaaccuagcgacggcaccauacucggacguuggugcggcuccggcaccguccccggcaaacaaaucuccaaaggcaaccaaauccgaauacgcuucguauccgacgaauacuucccauccgaacccggcuucugcauccacuacaacaucgucaugccccaauucaccgaagccgucucccccuccguacuaccccccuccgcccucccccucgaucuucucaacaacgccaucacggccuucuccacccucgaagaccuaauacgcuaccuggaacccgaaagauggcaacucgaucucgaagaucuauaccgccccacauggcaacuccucggcaaagccuucgucuucggcagaaaaucccgggucguagaccucaaccuccucaccgaagaaguacgccuauacuccugcacaccacgcaacuucuccguauccauccgagaagaacucaaacgcaccgacacuaucuucuggcccggcugccuccucgucaaaagaugcggcggaaacugcgccugcugucuccacaacugcaacgaaugccaaugcguccccuccaaaguaaccaaaaaauaccacgaaguccuacaacuucgcccaaaaaccggcguaagaggccuccacaaaucccucaccgacgucgcacuagaacaccacgaagaaugcgacugcgucugccgcggcuccaccggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3600 - RNA, 1477 nt, Artificial Sequence
  mRNA product Design2 comprising derived and/or modified sequence from Homo sapiens__NP_149126.1__HsPDGFD (opt11)
ggggcgcugccuacggagguggcagccaucuccuucucggcaucaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauucgacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagagcuaaaacucgccaacguagucuucuucccccgcugccuucucguccaaagaugcggcggcaacugcggcuguggaaccguaaacuggcgcagcugcaccugcaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3601 - RNA, 1060 nt, Artificial Sequence
  mRNA product Design2 comprising derived and/or modified sequence from Homo sapiens__NP_003946.3__HsSOCS3 (opt11)
ggggcgcugccuacggagguggcagccaucuccuucucggcaucaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuccucgaccaauacgaugcaccccuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3602 - RNA, 865 nt, Artificial Sequence
  mRNA product Design2 comprising derived and/or modified sequence from Homo sapiens__NP_003227.1__HsTGFA (opt11)
ggggcgcugccuacggagguggcagccaucuccuucucggcaucaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugccgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccugcguccuaauccacugcugccaaguccgcaaacacugcgaauggugccgcgcccucaucugccgccacgaaaaacccuccgcccuccucaaaggccgcaccgccugcugccacuccgaaacagucguuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3603 - RNA, 1555 nt, Artificial Sequence
  mRNA product Design2 comprising derived and/or modified sequence from Homo sapiens__NP_000651.3__HsTGFB1 (opt11)
ggggcgcugccuacggagguggcagccaucuccuucucggcaucaagcuuaccaugccucccucuggccuucgacugcucccccuccuccucccccuccuauggcuccuaguccuaacacccggccgcccagccgcaggccucuccacaugcaaaacaauagacauggaacucgucaaacgaaaacgcaucgaagcaauccgcggccaaauacucucuaaacuucgccucgccucaccacccucccaaggcgaagucccaccaggaccccuccccgaagccguauuagcucucuacaacuccacacgcgaccgcgucgcaggcgagagcgccgaacccgaacccgaaccugaagcugacuacuacgccaaagaaguaacacgcguccucaugguugaaacccacaacgaaaucuaugacaaauucaaacaauccacccacucaaucuacauguucuuuaacacaucagaacuccgcgaagccguccccgaaccaguccuccuuucccgugccgaacuccgccuacugcgccucaaacuaaaaguagaacaacacguugaacucuaccaaaaauacucaaacaauuccuggcgauaccucuccaaccgccuccucgcccccuccgacagccccgaauggcucucuuuugacgucacaggcgucguacgccaauggcucucaagaggcggcgaaaucgaaggcuuccgccucucagcccauugcucuugcgacucucgcgacaacacccuccaagucgacaucaacggcuucaccaccggccgacgcggcgaccucgccaccauccacggcaugaaccguccuuuccuacuucuaauggccacaccccucgaacgcgcccaacaccuccaaucaucacgccacagacgcgcccucgacaccaacuacugcuucuccuccaccgaaaagaacugcugcguacgccaacucuacaucgacuuccguaaagaccucggcuggaaauggauccacgaacccaaaggcuaccacgccaacuucugucuuggcccaugccccuacaucuggucccuagacacucaauacuccaaaguccuagcccuuuacaaccaacacaaccccggcgcaucagccgcccccugcugcguaccccaagcccucgaaccacuccccauagucuacuacguaggccgaaaacccaaagucgagcaacuauccaacaugaucguccggucgugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3604 - RNA, 1627 nt, Artificial Sequence
  mRNA product Design2 comprising derived and/or modified sequence from Homo sapiens__NP_003229.1__HsTGFB2 (opt11)
ggggcgcugccuacggagguggcagccaucuccuucucggcaucaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuccgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagagcuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3605 - RNA, 1621 nt, Artificial Sequence
  mRNA product Design2 comprising derived and/or modified sequence from Homo sapiens__NP_003230.1__HsTGFB3 (opt11)
ggggcgcugccuacggagguggcagccaucuccuucucggcaucaagcuuaccaugaaaaugcaccuccaacgagcccuagucguccucgcacuacucaacuucgcaaccgucucccuaagccuuuccacaugcaccacccuggacuucggccacaucaaaaagaaacgugucgaagccauucgaggccaaauacucagcaaacuccgccucacaucacccccagaacccacaguuaugacccacguccccuaccagguccuagcccuauacaacagcacccgcgaacuccucgaagaaaugcacggcgaacgcgaagaaggcugcacccaagaaaauacagaguccgaauauuaugcaaaagaaauccacaaauucgacaugauccagggccucgccgaacacaacgagcucgccgucugucccaaaggcaucaccuccaaaguauucagauucaacgugucauccgucgagaaaaaccgcaccaaccucuuccgcgccgaguuccguguccuccgcgucccaaaccccuccagcaaacgaaacgaacaacgaauagaacuauuccagauccuccgccccgacgaacacaucgccaaacaacgcuacauugggggcaaaaaccuccccacccgcggaacagccgaauggcuauccuucgacgucaccgacaccguccgcgaauggcuacuaagaagagaauccaaccucggccucgaaaucuccauacacugccccugccacaccuuccaacccaacggagacauacucgaaaacauccacgaaguaauggaaaucaaguucaaaggagucgacaacgaagacgaccacggccgcggcgaccuaggccgccucaaaaagcagaaagaccaccacaacccccaccuaauacuaaugaugauacccccucaccgccucgacaaccccggccaaggcggacaacgcaaaaagcgcgcccucgacacuaacuacugcuuccgcaaccucgaagaaaacugcugcguccgcccccucuacaucgacuuccgccaagaccucggguggaaauggguacacgaacccaaaggcuacuacgccaacuucugcagcggaccaugcccauaccucagaagcgcagacacaacacacuccaccguccucggccucuacaacacccuaaaccccgaagccucagccucccccugcugcguaccacaagaccuugaaccacucaccauccucuauuacguaggccgcacccccaaagucgaacaacucucaaacauggucguaaaaucaugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3606 - RNA, 1768 nt, Artificial Sequence
  mRNA product Design2 comprising derived and/or modified sequence from Homo sapiens__NP_001057.1__HsTNFRSF1B (opt11)
ggggcgcugccuacggagguggcagccaucuccuucucggcaucaagcuuaccauggcaccagucgcagucugggccgcccucgccguaggccuugaacucugggcagccgcccacgcccucccagcacaagucgcauucacucccuacgcacccgaacccggcuccaccugccgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcuugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccugcucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccugcaucgugaacguuuguuccuccucagaucacagcucccaaugcucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3607 - RNA, 895 nt, Artificial Sequence
  mRNA product Design2 comprising derived and/or modified sequence from Homo sapiens__NP_002623.2__HsPGF (opt11)
ggggcgcugccuacggagguggcagccaucuccuucucggcaucaagcuuaccaugccggucaugcgccuguucccgugcuuucuccagcuacuggccgggcucgcgcucccggccgugcccccgcaacaaugggcgcucucggccggaaacgggagcucggaaguggaaguggucccguuccaggaagugugggggcgcucguacugucgagcgcucgagcgcuuggucgaugucgugagcgaguacccgagcgaggucgagcacauguucucgcccucgugcgugagcuugcuaaggugcacgggauguugcggggacgagaacuugcacuguguaccggucgagaccgcgaacgugaccaugcaauugcucaagaucaggagcggggacaggcccucguacguggaauugaccuuuagccagcacgugcgcugugaaugucgcccgcucagggaaaagaugaagccagagcgcaggcgcccgaaagggcgagggaaaaggcgcagggaaaagcaaagacccacggacugucacuugugcggggacgcggucccgaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3608 - RNA, 1621 nt, Artificial Sequence
  mRNA product Design2 comprising derived and/or modified sequence from Homo sapiens__NP_001020537.2__HsVEGFA (opt11)
ggggcgcugccuacggagguggcagccaucuccuucucggcaucaagcuuaccaugaccgauagacagaccgacacagcgcccucacccucguaccaucucuugccggggaggaggagaacgguagacgcggcggcaucgcgcgggcaagggccggaaccagcgccagggggaggagucgaaggagugggagcgagaggggucgcgcuaaaacucuucguccaacugcugggaugcagcagguucgggggagcagugguaagagcaggagaggcagagccaucgggcgcggcaaggagcgcaagcucgggaagggaggaaccacagccagaagaaggggaagaggaagaggaaaaggaagaagaaaggggaccacaauggagacuaggcgcgagaaagccagggagcuggacaggggaggcggccgugugcgcggacucggcaccagccgcaagagcgccgcaggcacuagcaagggccucgggaaggggaggaaggguggcaagacgaggagccgaggaaucaggaccaccacacagcccaagcaggcgagggagcgcgagcagggcagggcccgggagagcaagcgagacaaugaacuuucucuugagcuggguacauuggucgcuagcgcuccuacuguaucugcaccacgcgaaauggagccaggcagcgccaauggcagagggaggagggcagaaccaccacgaagucgugaaauucauggauguauaccaaaggagcuacugccacccaauagaaacgcuaguagacauauuccaggaauauccagaugaaauugaauacauauucaaaccgagcugcguaccacucaugagguguggcggaugcuguaacgaugaagggcuagagugcgugccaacagaagagagcaacauaacaaugcaaauaaugcgaauaaaaccacaccaaggacagcacauaggagagaugagcuuccuacaacacaacaagugcgagugcaggccaaagaaagacagagcgcgccaagaaaagaaaagcguaaggggaaaggggaagggacagaaaaggaaaaggaaaaagaguagauacaaaaguuggagcguauacguaggagcgagaugcugcuugaugccguggucacuaccgggaccacacccgugugggcccugcagcgagagacgaaaacaccuauucgugcaggacccgcagacgugcaagugcucguguaagaacacggacucgaggugcaaagcgagacagcuagagcugaaugaaaggaccugccgaugugacaagcccagaagguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3609 - RNA, 1081 nt, Artificial Sequence
  mRNA product Design2 comprising derived and/or modified sequence from Homo sapiens__NP_001165094.1__HsVEGFA (opt11)
ggggcgcugccuacggagguggcagccaucuccuucucggcaucaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugccgcugcgacaaaccccgacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3610 - RNA, 1006 nt, Artificial Sequence
  mRNA product Design2 comprising derived and/or modified sequence from Homo sapiens__NP_003368.1__HsVEGFB (opt11)
ggggcgcugccuacggagguggcagccaucuccuucucggcaucaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugccaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3611 - RNA, 1642 nt, Artificial Sequence
  mRNA product Design2 comprising derived and/or modified sequence from Homo sapiens__NP_005420.1__HsVEGFC (opt11)
ggggcgcugccuacggagguggcagccaucuccuucucggcaucaagcuuaccaugcaccuccuaggcuucuucagcguugccugcucccuacuggccgccgcccuccucccuggcccccgcgaagcucccgcagccgcagcagccuuugaaucaggucucgaccuuagcgacgcagaacccgacgccggagaagcuaccgccuacgcgagcaaagaccucgaagaacaacugcgauccgucuccuccgucgacgaacucaugacuguacucuaccccgaauacuggaaaauguacaaaugccaacuccggaaaggaggcuggcaacacaacagagaacaagccaaccucaacucccgaaccgaagaaacuaucaaauucgccgcagcccacuacaacaccgaaauacucaaaucaaucgacaacgaauggagaaaaacccaaugcaugccccgagaagucugcaucgacgucggcaaagaguucggagucgccaccaacacauucuucaaaccaccuuguguauccgucuaccgaugcggagguugcugcaacuccgaaggccuacaaugcaugaacaccuccaccucauaccucucaaaaacacucuucgaaaucaccgucccccuaagccaaggcccgaaaccagucaccauuuccuucgcaaaccauacaucaugccgauguaugucaaaacucgacgucuaccgccaaguccacuccauaauccgacgcucacucccagccacccucccccaaugccaagcagcaaacaaaaccugcccaaccaacuacauguggaacaaccacaucugccgcugccucgcacaagaagacuucauguucagcuccgacgccggcgacgacuccaccgacggcuuccacgacaucugcggccccaacaaagaacucgacgaagaaacaugccaaugcguuugucgcgccggccuccgcccagccuccugcggaccacacaaagaacucgacagaaacuccugccaaugcguuugcaaaaacaaacuauucccaucccaaugcggagccaaccgcgaguucgacgaaaauaccugccaaugcguaugcaaacgaaccugcccccgaaaccaaccccuaaaccccggcaaaugcgcuugcgaaugcaccgaauccccgcaaaaaugccuccucaaaggaaagaaauuccaccaccaaaccugcuccugcuaccgccgacccugcaccaaccgucaaaaagcgugcgaacccggauucuccuacuccgaagaagucugccgcugcguccccagcuacuggaaacgcccccaaauguccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3612 - RNA, 1447 nt, Artificial Sequence
  mRNA product Design2 comprising derived and/or modified sequence from Homo sapiens__NP_004460.1__HsVEGFD (opt11)
ggggcgcugccuacggagguggcagccaucuccuucucggcaucaagcuuaccauguaccgagaaugggucgucgucaacguauucaugaugcucuacguacaacucguccaaggcagcagcaacgaacacggccccgucaagagauccagccaaagcacccuagaacgauccgaacaacaaauacgcgcagccucaagccucgaagaguuacuacgaaucacccacucagaagacuggaagcucuggcgaugccgccuccgccucaaguccuucaccuccauggacagcagaucagccucccaccgcucaacccguuucgccgccaccuucuacgacaucgaaacccucaaagucaucgacgaggaauggcaacgaacacaaugcucucccagagaaaccugcguagaagucgccuccgaacuugguaaaucaaccaacacuuucuucaaaccacccugcgucaacgucuuccgcugcggaggcugcugcaacgaagagucccucauaugcaugaacacauccaccuccuacaucuccaaacaacucuucgaaauauccguaccccuaaccuccgucccagaacuuguacccgucaaagucgccaaccacaccggcugcaaaugccuccccacagcaccccgccaccccuacuccauaauccgccgaucgauacaaauaccggaagaagaccgcugcucacacucaaagaaacucugccccauagacaugcucugggacuccaacaaaugcaaaugcguccuccaggaagaaaacccccuagccggcacagaagaccacucccaccuccaagaaccagcccucugcggcccccauaugauguucgacgaagaccgcugcgaaugcguaugcaaaacccccugccccaaagaccucauccaacaccccaaaaacugcucaugcuucgaaugcaaagaaucacucgaaaccugcugccaaaaacacaaacucuuccaccccgacacaugcucaugcgaagaccgaugccccuuccacacccgccccugcgccuccggcaaaaccgccugcgccaaacacugccgauucccaaaagaaaaacgcgccgcccaaggcccccacucacgcaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3613 - RNA, 1012 nt, Artificial Sequence
  mRNA product Design2 comprising derived and/or modified sequence from Homo sapiens__NP_061986.1__HsFGF21 (opt12)
ggggcgcugccuacggagguggcagccaucuccuucucggcaucaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3614 - RNA, 1792 nt, Artificial Sequence
  mRNA product Design2 comprising derived and/or modified sequence from Homo sapiens__NP_002412.1__HsMMP1 (opt12)
ggggcgcugccuacggagguggcagccaucuccuucucggcaucaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3615 - RNA, 1552 nt, Artificial Sequence
  mRNA product Design2 comprising derived and/or modified sequence from Homo sapiens__NP_002412.1__HsMMP1(1-19,100-469) (opt12)
ggggcgcugccuacggagguggcagccaucuccuucucggcaucaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3616 - RNA, 3739 nt, Artificial Sequence
  mRNA product Design2 comprising derived and/or modified sequence from Clostridium histolyticum__BAA77453.1__ColG (opt12)
ggggcgcugccuacggagguggcagccaucuccuucucggcaucaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3617 - RNA, 3463 nt, Artificial Sequence
  mRNA product Design2 comprising derived and/or modified sequence from Clostridium histolyticum__BAA77453.1__HsALB(1-18)_ColG(111-1118) (opt12)
ggggcgcugccuacggagguggcagccaucuccuucucggcaucaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3618 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt12)
ggggcgcugccuacggagguggcagccaucuccuucucggcaucaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3619 - RNA, 3487 nt, Artificial Sequence
  mRNA product Design2 comprising derived and/or modified sequence from Clostridium histolyticum__BAA34542.1__ColH (opt12)
ggggcgcugccuacggagguggcagccaucuccuucucggcaucaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3620 - RNA, 3448 nt, Artificial Sequence
  mRNA product Design2 comprising derived and/or modified sequence from Clostridium histolyticum__BAA34542.1__ColH (opt12)
ggggcgcugccuacggagguggcagccaucuccuucucggcaucaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3621 - RNA, 3382 nt, Artificial Sequence
  mRNA product Design2 comprising derived and/or modified sequence from Clostridium histolyticum__BAA34542.1__HsALB(1-18)_ColH(41-1021) (opt12)
ggggcgcugccuacggagguggcagccaucuccuucucggcaucaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3622 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt12)
ggggcgcugccuacggagguggcagccaucuccuucucggcaucaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3623 - RNA, 958 nt, Artificial Sequence
  mRNA product Design2 comprising derived and/or modified sequence from Homo sapiens__NP_001133.1__HsAMELX (opt12)
ggggcgcugccuacggagguggcagccaucuccuucucggcaucaagcuuaccaugggaacauggauacuuuucgcaugccuacucggagcagcauucgcaaugccacuaccaccacacccaggacacccaggauacauaaacuucucauacgaaguacuaacaccacuaaaaugguaccaaucaauaagaccaccauacccaucauacggauacgaaccaaugggaggaugguuacaccaccaaauaauaccaguacuaucacaacaacacccacccacacacacauuacaaccacaccaccacauaccaguaguaccagcacaacaaccaguaauaccacaacaaccaaugaugccaguaccaggacaacacuccaugacaccaauacaacaccaccaaccaaaccuaccaccaccagcacaacaaccauaccaaccccaaccaguacaaccacaaccacaccaaccaaugcaaccacaaccaccaguacacccaaugcaaccacuaccaccacaaccaccacuaccaccaauguucccaaugcaaccacuaccaccaaugcucccagaccuaacacuagaagccuggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3624 - RNA, 517 nt, Artificial Sequence
  mRNA product Design2 comprising derived and/or modified sequence from Homo sapiens__NP_001133.1__HsAMELX-TRAP (opt12)
ggggcgcugccuacggagguggcagccaucuccuucucggcaucaagcuuaccaugccucuaccuccacauccaggucacccuggauauauaaauuucucuuacgaaguacuuacaccucuaaaaugguaucaaucuauacguccaccuuacccuucauauggauaugaaccuauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3625 - RNA, 550 nt, Artificial Sequence; identical to SEQ ID NO: 3165
  mRNA product Design2 comprising derived and/or modified sequence from Homo sapiens__NP_001133.1__HsAMELX-LRAP (opt12)

SEQ ID NO: 3626 - RNA, 589 nt, Artificial Sequence; identical to SEQ ID NO: 3166
  mRNA product Design2 comprising derived and/or modified sequence from Homo sapiens__NP_001133.1__HLA-A2-SP_HsAMELX(17-60) (opt12)

SEQ ID NO: 3627 - RNA, 622 nt, Artificial Sequence
  mRNA product Design2 comprising derived and/or modified sequence from Homo sapiens__NP_001133.1__HLA-A2-SP_HsAMELX(17-47,168-191) (opt12)
ggggcgcugccuacggagguggcagccaucuccuucucggcaucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3628 - RNA, 961 nt, Artificial Sequence
  mRNA product Design2 comprising derived and/or modified sequence from Homo sapiens__NP_001134.1__HsAMELY (opt12)
ggggcgcugccuacggagguggcagccaucuccuucucggcaucaagcuuaccaugggaacauggauccuauucgcuugccuaguaggagcagcauucgccaugccauuaccaccacacccaggacacccaggauacauaaacuucucauacgaaguacuaacaccacucaaaugguaccaaucaaugauaagaccaccauacucaucauacggauacgaaccaaugggaggauggcuacaccaccaaauaauaccaguaguaucacaacaacacccauuaacacacacacuacaaucacaccaccacauaccaguaguaccagcacaacaaccaagaguaagacaacaagcacucaugccaguacccggacaacaaucaaugacaccaacacaacaccaccaacccaaccuaccacuaccagcacaacaaccauuccaaccacaaccaguccaaccacaaccacaccaaccaaugcaaccacaaccaccuguacaaccaaugcaaccacuauuaccacaaccaccacucccacccauguucccacuaagaccacuaccaccaauacuaccagaccuacaccuagaagcauggccagcaacagacaaaacaaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3629 - RNA, 520 nt, Artificial Sequence; identical to SEQ ID NO: 3169
  mRNA product Design2 comprising derived and/or modified sequence from Homo sapiens__NP_001134.1__HsAMELY-TRAP (opt12)

SEQ ID NO: 3630 - RNA, 553 nt, Artificial Sequence
  mRNA product Design2 comprising derived and/or modified sequence from Homo sapiens__NP_001134.1__HsAMELY-LRAP (opt12)
ggggcgcugccuacggagguggcagccaucuccuucucggcaucaagcuuaccaugccacuaccaccacacccaggacacccaggauacauaaacuucucauacgaaguacuaacaccacuaaaaugguaccaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3631 - RNA, 592 nt, Artificial Sequence; identical to SEQ ID NO: 3171
  mRNA product Design2 comprising derived and/or modified sequence from Homo sapiens__NP_001134.1__HLA-A2-SP_HsAMELY(17-61) (opt12)

SEQ ID NO: 3632 - RNA, 625 nt, Artificial Sequence; identical to SEQ ID NO: 3172
  mRNA product Design2 comprising derived and/or modified sequence from Homo sapiens__NP_001134.1__HLA-A2-SP_HsAMELY(17-48,169-192) (opt12)

SEQ ID NO: 3633 - RNA, 952 nt, Artificial Sequence
  mRNA product Design2 comprising derived and/or modified sequence from Sus scrofa__NP_999071.1__SsAMELX-001-1 (opt12)
ggggcgcugccuacggagguggcagccaucuccuucucggcaucaagcuuaccaugggaaccuggauauuauucgcaugccuacuaggagcagcauucucaaugccacuaccaccacacccaggacacccaggauacauaaacuucuccuacgaaguauuaacaccacuaaaaugguaccaaaacaugauaagacaccccuacacaucauacggauacgaaccaaugggaggauggcuacaccaccaaauaauacccguaguaucacaacaaacaccacaaucacacgcacuacaaccccaccaccacauaccaaugguaccagcacaacaaccaggaauaccacaacaaccaaugaugccacuaccaggacaacacucaaugacaccaacacaacaccaucaaccaaaccuaccacuaccagcacaacaaccauuccaaccacaaccaguacaaccacaaccacaccaaccacuacaaccccaaucaccaaugcaccccauacaaccacuacuaccacaaccaccacuaccaccaauguucucaaugcaaucacuacuacccgaccuaccacuagaagcauggccagcaacagacaaaacaaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3634 - RNA, 520 nt, Artificial Sequence; identical to SEQ ID NO: 3174
  mRNA product Design2 comprising derived and/or modified sequence from Sus scrofa__NP_999071.1__SsAMELX-TRAP (opt12)

SEQ ID NO: 3635 - RNA, 553 nt, Artificial Sequence; identical to SEQ ID NO: 3175
  mRNA product Design2 comprising derived and/or modified sequence from Sus scrofa__NP_999071.1__SsAMELX-LRAP (opt12)

SEQ ID NO: 3636 - RNA, 592 nt, Artificial Sequence; identical to SEQ ID NO: 3176
  mRNA product Design2 comprising derived and/or modified sequence from Sus scrofa__NP_999071.1__HLA-A2-SP_SsAMEL(17-61) (opt12)

SEQ ID NO: 3637 - RNA, 625 nt, Artificial Sequence; identical to SEQ ID NO: 3177
  mRNA product Design2 comprising derived and/or modified sequence from Sus scrofa__NP_999071.1__HLA-A2-SP_SsAMEL(17-49,167-189) (opt12)

SEQ ID NO: 3638 - RNA, 916 nt, Artificial Sequence
  mRNA product Design2 comprising derived and/or modified sequence from Sus scrofa__P45561-2__SsAMELX-001-2 (opt12)
ggggcgcugccuacggagguggcagccaucuccuucucggcaucaagcuuaccaugggaacauggauauuauucgcaugccuacuaggagcagccuucucaaugccacuaccaccacacccaggacacccaggauacauaaacuucucauacauaagacauccauacacaucauacggauaugaaccaaugggaggauggcuacaccaccaaauaauaccaguaguaucacaacaaaccccacaaucacacgcacuacaaccacaccaccacauaccaaugguaccagcacaacaaccaggaauaccacaacaaccaaugaugccauuaccaggacaacacuccaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccccaaccaccacuaccaccaauguucucaaugcaaucacuacuaccagaccuaccacuagaagcauggccagccacagacaaaacaaaacgagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3639 - RNA, 952 nt, Artificial Sequence
  mRNA product Design2 comprising derived and/or modified sequence from Sus scrofa__NP_998965.1__SsAMELX-001-3 (opt12)
ggggcgcugccuacggagguggcagccaucuccuucucggcaucaagcuuaccaugggaacauggauauucuucgcaugcuuacuaggagcauccuuagcaaugccacuaccaccacacccaggccacccaggauacauaaacuucucauacgaaguacuaacaccacuaaaaugguaccaaaacaugauaagacacccauacacaucauacggcuacgaaccaaugggcggcuggcuacaccaccaaauuauaccaguaguaucacaacaaacaccacaaucacacgcacuacaaccccaccaccacauaccaaugguaccagcacaacaacccggaauaccacaacaaccaaugaugccacucccaggacaacacucaaugacaccaacacaacaccaccaaccaaaccucccacuaccagcacaacaaccauuccaaccccaaccaguacaaccacaaccacaccaaccacuacaaccacaaucaccuaugcacccaauacaaccauuacuaccccaaccaccacuaccaccaauguucucaaugcaaucacuacuaccagaccuaccacuagaagcauggccagcaacagacaaaacaaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3640 - RNA, 601 nt, Artificial Sequence; identical to SEQ ID NO: 3180
  mRNA product Design2 comprising derived and/or modified sequence from Sus scrofa__K7GPB2__SsAMELX-002 (opt12)

SEQ ID NO: 3641 - RNA, 994 nt, Artificial Sequence
  mRNA product Design2 comprising derived and/or modified sequence from Sus scrofa__K7GLD0__SsAMELX-003 (opt12)
ggggcgcugccuacggagguggcagccaucuccuucucggcaucaagcuuaccaugggaacauggauacuauucgcaugccuacuaggcgcagcauucucaaugccacuaccaccacaccccggacacccaggcuacauaaacuucucauacgaagauuuauacuuagaagcaauaagaauagacagaacagcauuuguauuaacaccacuaaaaugguaccaaaacaugauaagacacccauacacaucauauggauacgaacccaugggaggauggcuacaccaccaaauaaucccaguaguaucacaacaaacaccacaaucacacgcccuacaaccacaccaccacauaccaaugguaccagcacaacaaccaggaauaccacaacaacccaugaugccacuaccaggacaacacucaaugacaccaacacaacaccaccaacccaaccuaccacuaccagcacaacaaccauuccaaccacaaccaguacaaccacaaccacaccaaccauuacaaccacaaucaccaaugcacccaauacaaccccuacuaccacaaccaccacuaccaccaauguucucaaugcaaucacuacuaccagaccuaccacuagaagccuggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3642 - RNA, 880 nt, Artificial Sequence
  mRNA product Design2 comprising derived and/or modified sequence from Sus scrofa__K7GPE9__SsAMELX-004 (opt12)
ggggcgcugccuacggagguggcagccaucuccuucucggcaucaagcuuaccaugggaacauggauacuauucgcaugccuacuaggagcagcauucucaaugccacucccaccacacccaggacacccaggauacauaaacuucucauacgaaguacuaacaccacuaaaaugguaccaaaacaugauaagacacccaacaccacaaucacacgcacuccaaccacaccaccacauaccaaugguaccagcacaacaacccggaauaccacaacaaccaaugaugccacuaccaggacaacacuccaugacaccaacacaacaccaccaaccaaaccucccacuaccagcacaacaaccauuccaaccacaaccaguacaaccacaaccacaccaaccacuacaaccacaaucacccaugcacccaauacaaccacuacucccacaaccaccacuaccaccaauguucucaaugcaaucacuacuaccagaccucccacucgaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3643 - RNA, 904 nt, Artificial Sequence
  mRNA product Design2 comprising derived and/or modified sequence from Sus scrofa__J9JIM4__SsAMELX-201 (opt12)
ggggcgcugccuacggagguggcagccaucuccuucucggcaucaagcuuaccaugccacucccaccacacccaggacacccaggauacauaaacuucucauacgaaguacucacaccccuaaaaugguaccaaaacaugauaagacaccccuacacaucauacggauacgaacccaugggaggauggcuacaccaccaaauaauaccaguagucucacaacaaacaccacaaucacacgcacuccaaccacaccaccacaucccaaugguaccagcacaacaaccaggaauaccacaacaaccaaugaugccacuaccaggacaacacucaaugacaccaacacaacaccaccaaccaaaccuaccacuacccgcccaacaaccauuccaaccccaaccaguacaaccacaaccacaccaaccacuccaaccacaaucaccaaugcacccaauacaaccacuacuaccacaaccaccacucccaccaauguucucaaugcaaucacuacucccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3644 - RNA, 3343 nt, Artificial Sequence
  mRNA product Design2 comprising derived and/or modified sequence from Homo sapiens__NP_006120.1__HsBMP1 (opt12)
ggggcgcugccuacggagguggcagccaucuccuucucggcaucaagcuuaccaugccugggguugcaagacuaccguuacuauugggauuacuacuauuaccaaggccaggaagaccauuagauuuagcagauuauacguaugauuuagcagaagaagacgauagugaaccauuaaauuauaaagauccauguaaagcagccgcguuuuuaggggacauagcacuagaugaagaagaucuaagagcauuucaaguacaacaagcaguugaccuaagaagacacacagcuagaaaaucaucaauuaaagccgcugucccgggaaauacgaguacaccgaguugucaaucuacuaacggacagccacaacguggugcaugcggaagauggagaggacgcucaaggagucggagagcggcaacaagcagaccagaaagggucuggccagauggaguaauaccuuucguaauaggaggaaauuuuacaggaagucaaagagcaguauuccgucaagcuaugagacauugggaaaaacauaccuguguaacguuuuuagaaagaacagaugaagauaguuacauaguguuuacguaucgaccaugcggauguuguucuuacguaggaagacgagggggugguccccaagcaauaucaauagguaaaaacugcgauaaauucgggauaguaguacaugaacuagggcauguaguuggauuuuggcaugaacacacacgacccgauagagauagacaugucucaauaguaagggaaaacauacaacccggacaagaauauaauuucuuaaaaauggaaccacaagaaguugaaaguuuaggugaaacguaugacuucgauaguauuaugcauuaugcacgaaauaccuuuaguagaggaauuuuucuugacacuauaguaccgaaauaugaaguaaaugguguaaaaccaccaauaggucaaagaacaagauuaucaaaaggagauauagcacaagcucgaaaacuguacaaaugcccagcuuguggugaaacauugcaagauucaacaggaaauuucaguagcccagaauacccaaacggauauagugcgcauaugcauugcgucuggaggauuaguguaacaccaggugagaaaauaauacuaaauuuuacgaguuuagacuuauaucgaagcagauuauguugguaugacuauguugaaguuagagauggauuuuggagaaaagcaccauuaagaggaagauuuuguggaucaaaacuaccagaaccaauaguaaguacagauaguaggcuuuggguagaguucagaagcucgaguaauuggguaggcaaaggauucuuugcagucuaugaagccauauguggaggggauguuaagaaagacuauggacacauacaaucaccuaauuauccggacgauuaccgaccaagcaaaguuuguauuuggcggauucaaguaagcgaagguuuccacguaggacuuacauuccaaucuuuugaaauugaacgccaugauaguugcgcauacgacuaucuagaaguaagagauggucauagcgaaaguucaacacuaauuggaagauacugcggauaugaaaaaccugacgauauaaaaucaacaagcagucgauuauggcuaaaauuugugagugacggaagcauaaauaaagcuggcuucgcuguaaacuuuuucaaagaaguagaugaauguaguagaccaaauaggggcggaugugaacaacguuguuuaaauacuuuaggcucguauaaaugcagcugugaucccggauaugaacucgcaccagauaaaagaagaugugaagcagcauguggaggauuuuugacaaaacuuaaugguuccauaaccaguccaggguggccaaaagaauauccgccaaauaaaaauugcauuuggcagcuaguagcuccaacucaauaccguaucaguuuacaauucgacuucuuugaaacagaaggcaaugacguaugcaaauacgauuuuguagaaguuagaucugggcuaaccgcugacaguaaauuacauggaaaauuuuguggcucagaaaaaccagaaguaaucacaucacaauacaauaacaugagagucgaguuuaaaagcgauaacacaguuaguaagaaagguuuuaaagcccauuucuuuagugauaaagaugaaugcucaaaagauaauggagggugucaacaagauugcguaaauacauuuggaagcuacgaaugccaauguagauccggauuuguacuccaugauaauaaacacgauuguaaagaagcaggaugugaccacaaaguaaccucuacaucggggacuaucacgaguccaaacuggccagauaaauacccuucaaagaaagaaugcacuugggcgaucaguucuacuccaggacauaggguuaaauuaacauuuauggaaauggacauagaaucacaaccugaaugugcuuaugaccauuuagaaguuuuugauggaagagaugcuaaagcgccuguuuuaggucgguuuugcggaaguaaaaagccugaaccugucuuagccacuggcucaaggauguuuuuaagguuuuauucagacaacucaguccaaagaaaaggauuucaagcaagucaugcgacagaaugcggaggccaaguacgagcagauguaaaaacaaaagaucuuuauucucaugcacaauuuggugauaauaauuauccuggaggaguugauugugaguggguaauaguagcagaagaagguuauggaguugaauuaguauuucaaacguuugaaguagaagaagaaaccgauugcgguuaugacuacauggaacuauucgaugguuaugauucaacagcuccuagauuaggaagauauugugggucaggcccgccagaggaaguauauagugcaggagauagcguucuaguaaaauuucacagcgacgacacaauaaccaagaaaggauuccaucuacgcuauacaucaacuaaauuccaagauacacuacauagcagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3645 - RNA, 1573 nt, Artificial Sequence
  mRNA product Design2 comprising derived and/or modified sequence from Homo sapiens__NP_001191.1__HsBMP2 (opt12)
ggggcgcugccuacggagguggcagccaucuccuucucggcaucaagcuuaccauggucgcaggaacaagaugucuacuagcacuauuacuuccacaaguucuacuaggaggagcagcuggauuaguaccagaauuaggaagaagaaaauuugcggcagcaucaucuggaagacccaguucacaaccaucagacgaaguauuaucagaauuugaacuuagacuacuuagcauguucggauuaaaacaacgucccacaccaucuagagaugcaguaguaccacccuauaugcuugaccuauacagacgucacagcggccaaccaggaucaccagcaccagaccauagacuagaaagagccgcaucaagagcaaacacaguaagaucauuccaccaugaagaaagcuuagaagaauuaccagaaacaucagguaaaacuacaagaagguuuuucuuuaacuuaagcucuauaccaacagaagaauuuauaacaucagcagaauuacaaguauucagagaacaaaugcaagacgcacuaggcaauaauagcagcuuucaccacagaauaaauauauaugaaauuauaaaaccagcaacagcaaacucaaaauuuccaguaacaagacuauuagacacacgacuaguaaaucaaaaugcaucaagaugggaauccuucgacguaacaccagcaguaaugagauggacagcacaaggacacgcaaaccauggauuuguaguagaaguagcucacuuagaagaaaaacaaggaguaaguaaacgucauguaagaauuagcagaaguuuacaucaagacgaacauuccuggucucaaauuagaccacuacuaguaacauucggacaugacggaaaaggacacccacuacacaaaagagaaaaacgacaagcaaaacauaaacaacguaaaagauuaaaauccucauguaaaagacauccauuauacguagauuucucagacguaggauggaacgacuggauaguagcaccacccggauaccacgcuuucuauugccauggagaaugcccauucccacuugcagaccaucuaaacagcacaaaucacgccauuguacaaacauuaguaaacagcguaaacuccaaaauaccaaaagcaugcugcguuccaacagaauuaagcgcaauaucaauguuauacuuagacgaaaaugaaaaaguaguacuaaaaaauuaccaagacaugguaguagaaggcuguggaugccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3646 - RNA, 1609 nt, Artificial Sequence
  mRNA product Design2 comprising derived and/or modified sequence from Homo sapiens__NP_001193.2__HsBMP4 (opt12)
ggggcgcugccuacggagguggcagccaucuccuucucggcaucaagcuuaccaugauaccaggaaauagaaugcuuaugguaguauuacuaugccaaguauuacuaggaggugcaucccaugccucauuaauaccagaaaccggcaaaaaaaaaguagcugaaauacaaggacaugcaggaggaagaagauccggacaaucacacgagcuacuaagagacuuugaagcuacauuauuacaaauguuuggauuacgaagaagaccacaaccuucaaaaucagcugucauuccagauuauaugagagacuuauauagauuacaaucuggugaagaagaagaagaacaaauccacucaacuggacuggaauauccagaaagaccagcuucaagagcuaauacuguucguucauuucaucacgaagaacauuuagaaaacauaccaggaacaagcgaaaauagugcauuuagauucuuauucaaccuauccagcauuccagaaaacgaaguaauaucaagugcagaauuaagauuauuucgugaacaaguagaucaaggaccagacugggaaagaggauuucacagaauuaacauauaugaaguuaugaaaccaccugcagaagucguaccaggucaccuaauaacaagauuauuagauacaagacuaguacaucauaacgucacaagaugggaaacuuuugacguaucaccagcaguauuacgauggacacgagaaaaacaaccaaauuacggucuagcaauagaaguaacacaccuacaucaaacaagaacccaccaaggacaacauguacgaauaucaagaucauuaccacaaggaagcggaaacugggcacaauuaagaccacuacuaguuacuuuuggacacgauggaagaggacacgcacuaacacggagaagaagagcaaaacguucaccaaaacaccauucucaaagagcaagaaaaaaaaauaaaaacugcagacgacauagcuuauauguagauuucucagauguaggguggaaugacuggauaguagcaccuccaggauaccaagcauuuuacugucacggugacuguccauuucccuuagccgaucacuuaaacucaacaaaucaugcaauaguacaaacacuaguaaacaguguaaacucaaguauaccuaaagcaugcugcguaccaacagaacuaucagcaauuucaauguuauaccuagacgaauaugacaaaguuguauuaaaaaauuaucaagaaaugguuguagaaggauguggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3647 - RNA, 1924 nt, Artificial Sequence
  mRNA product Design2 comprising derived and/or modified sequence from Homo sapiens__NP_001709.1__HsBMP6 (opt12)
ggggcgcugccuacggagguggcagccaucuccuucucggcaucaagcuuaccaugccaggacuagguagaagggcccaauggcuauguuggugguggggucuauuauguucauguuguggacccccuccucuaagaccaccauuaccagcugcugcagcagcagcagccggcgggcaauuacuaggagauggaggcucgccaggaagaacagaacaaccaccaccaucaccacaaucaucaucagguuuccuauacagacgacuuaaaacacaagaaaaacgagaaaugcaaaaagaaauauuaucuguuuuaggucuaccacauagaccuagaccacuacauggccuacaacaaccucaaccuccagcccuucgccaacaagaagaacaacaacaacaacaacaauuaccaagaggugagccaccacccgguagauuaaaaucagcuccuuuauucauguuagauuuauacaacgcccuauccgccgauaaugaugaagauggagcaucagaaggcgagaggcaacaaucauggccgcaugaagcagcuucaucaucacaacgccgacaaccaccuccuggugcugcacauccauuaaaucguaaaagccuacuugcaccaggaucaggaucuggaggagccucaccacuaacaagcgcacaagauucagcauuucuaaaugacgcugauauggucaugaguuuuguaaaucuaguagaauacgauaaagaguucucuccaagacaaagacaucauaaagaauuuaaauuuaaucuaucucaaaucccagaaggagaaguaguaacagcggcagaauuuagaauauauaaagauuguguaaugggaucauucaaaaaucaaacuuuucuaauuucaauauaccaaguauuacaagaacaucaacaucgcgacucagaccucuuuuuacucgacacccgaguuguuugggcauccgaagaaggcuggcuagaauuugauauuacagcaacaucaaauuuauggguaguaaccccucaacauaacauggguuuacaauuaaguguaguaacaagagacggaguucacguccacccaagagcugcaggauuaguaggaagagauggaccauaugacaaacaaccauucaugguugcauucuuuaaaguuagugaaguucauguacgaacaacaagaucagcaaguucaagaagaagacaacaaucuagaaaccgaaguacacaaucacaagauguugcacgaguaucaucugccagugacuauaauucaucagaauuaaaaacagcauguagaaaacacgaauuauacguaucauuucaagauuuagguuggcaagacuggauaauagcaccaaaaggauacgcagcaaauuauugugacggcgaauguucauuuccuuuaaaugcacauaugaaugcaacaaaccaugcaauaguccaaacauuaguccacuuaaugaauccagaauacguaccaaaaccuuguugugccccaacaaaauuaaaugcaaucucaguacuauacuucgaugauaauucaaauguaauauuaaagaaauaccgaaauaugguaguaagagcuugcggcugucacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3648 - RNA, 1678 nt, Artificial Sequence
  mRNA product Design2 comprising derived and/or modified sequence from Homo sapiens__NP_001710.1__HsBMP7 (opt12)
ggggcgcugccuacggagguggcagccaucuccuucucggcaucaagcuuaccaugcaugucagaucacuuagagcagcagccccacauucuuucguagcauuaugggcaccauuauucuuauuaagaagcgcacuagcagacuuuucauuagacaaugaaguacauaguagcuuuauacauagacgccuaagaucacaagaaagacgagaaaugcaaagagaaauccuaucaauauuaggauuaccacauagaccaagaccucaucuacaaggaaaacacaacuccgcuccaauguucauguuagaccuauauaacgcaauggcugucgaagaaggaggagguccaggaggacaagguuuuaguuaucccuacaaagcaguauuuagcacacaaggcccaccacucgcaagcuuacaagauucccauuuccuaacagaugccgauaugguuaugaguuucguuaaucuuguagaacacgauaaagaauucuuccacccuagauaucaccaucgagaguucagauucgaucuuucaaaaauaccagaaggagaagccguuaccgcagcagaauuuagaauauauaaagauuacauccgcgaacgauuugacaaugaaacauucagaauaucaguauaucaaguacuacaagaacaucuagggagagaaucagaucuauuuuuauuagacucuagaacacuaugggcaucagaagaaggaugguuaguuuucgauauaacagccacaagcaaucacuggguaguaaacccuagacacaacuuaggauuacaauuaagcguagaaacacucgacggccaaaguauaaaccccaaacuagcaggacuaauaggacgacacggcccacaaaacaaacaaccauuuauggucgccuuuuucaaagcuacagaaguacauuuccgaucaauacgaucuacaggauccaaacaaagaucacaaaacagaucuaaaacaccaaaaaaucaagaagcauuaagaauggccaauguagcagaaaauagcucaucagaucaacgacaagcaugcaaaaaacaugaacuauacgugaguuucagagaucucggauggcaagauuggauaauagcaccagaaggauaugcagccuauuauugugaaggugaaugugcauuuccacuaaauucuuacaugaaugcaaccaaucacgcaauaguucaaacacuaguacacuuuauaaacccagaaacaguaccaaaaccuuguugcgcaccaacacaauuaaacgcaaucucaguauuauacuucgaugauaguucuaacguaauauuaaaaaaauacagaaacaugguagucagagcaugcgguugucacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3649 - RNA, 682 nt, Artificial Sequence; identical to SEQ ID NO: 3189
  mRNA product Design2 comprising derived and/or modified sequence from Homo sapiens__NP_006264.2__HsCCL7 (opt12)

SEQ ID NO: 3650 - RNA, 4006 nt, Artificial Sequence
  mRNA product Design2 comprising derived and/or modified sequence from Homo sapiens__NP_001954.2__HsEGF (opt12)
ggggcgcugccuacggagguggcagccaucuccuucucggcaucaagcuuaccaugcuacucacguugauaauauuauuaccaguaguaucaaaauucucuuuuguuagccuaagugccccacaacauuggucuuguccagaagggacguuagccgggaauggaaacaguacaugugugggaccugccccauuuuuaauauuuucacacggaaauuccaucuuuagaaucgauacugaagggacaaauuaugaacaauuaguuguagaugccgguguaucaguaaucauggacuuccauuauaaugaaaaacggauuuacuggguugaucucgaaagacaacuacuucaaagaguguuuuuaaaugggaguaggcaagaaagagucuguaauauugagaaaaauguaucaggaauggcuauaaauuggauaaacgaagagguaauauggucuaaucaacaagaagguauuauaacugugacugauaugaaaggaaauaacucacauauccuccuaucugcucuaaaauauccugcuaacguggcaguugauccagucgaacgauuuaucuuuuggucaucagaggucgcaggaucgcuauauagagcagacuuagaugguguaggaguaaaagcauuacuagaaaccagcgagaaaauaacugcaguaaguuuagauguacucgacaaaagauuauucuggauacaauacaauagagaaggaucaaauucacuaauauguucuugugacuaugauggcggaagcguccacauaucuaaacaccccacacaacauaauuuauuugcgaugaguuuauuuggugauagaauauuuuauaguacguggaaaaugaaaaccauauggauagcuaauaaacauacaggaaaagacaugguccgaauaaaccuacacucauccuuuguaccucuaggggaauugaaaguaguacauccacuagcacaaccaaaagcggaagacgacacaugggaaccggaacaaaaacucuguaaacucagaaaggguaauuguucgaguacuguauguggacaagaucuacaaagccauuuauguaugugcgcagaaggauaugcuuuaucaagagaucgaaaauauugcgaagaugucaaugagugugcauuuuggaaucauggauguacccuuggcugcaaaaauaccccaggcucauauuauugcacuuguccaguaggauuuguauuguuaccugauggaaagcgaugucaucaacuuguaaguuguccacgaaauguuagugaauguucacaugauugcguguuaacaucagaaggcccauuaugcuucugcccagaaggaucaguguuagaaagagauggcaaaacuugcaguggaugcaguagcccagacaaugguggauguagucaauuauguguuccguuauccccagugucgugggaaugugacuguuuuccaggauaugauuuacagcuagacgaaaaaucuugcgcagcaagcgguccacaacccuuuuuacuauuugcaaauucccaagacauucgucacaugcauuuugaugguacugauuaugguacauuauuaucacaacaaauggguaugguauaugcauuagaccaugauccugucgaaaacaaaauauauuucgcucauacagccuuaaaguggaucgaacgcgcuaacauggauggaagucaaagagaaaggcucauugaagaaggagucgauguacccgaaggcuuagcaguagacuggauaggccgccgauuuuauuggacagauagagguaaaagucuuauaggacguucagacuuaaauggaaaaagaaguaaaauuauaacaaaagaaaacauaucacaaccuaggggaauagcaguacauccaauggcaaaacgccucuuuuggacagauacaggcauaaauccuagaauugaaaguucuagcuuacagggacuaggccggcuaguaauugccucaucagaccuaauauggccaagugggauaaccauagauuuucucacggacaaauuguauuggugcgaugcaaaacagucaguaauagaaauggcuaaucucgaugguucaaagagaaggagauuaacacagaacgauguuggucacccauucgcaguagcaguauucgaggauuacgucugguuuucggauugggcaaugccaaguguaaugagaguaaacaaaagaacagguaaagauagaguacgauuacaaggauccauguuaaagcccuccucauuaguagucguucauccauuggcuaaaccaggagccgacccaugcuuauaccaaaauggugguugugaacacauuuguaagaaaagauuaggaacagccugguguucaugcagagaaggcuucaugaaagcaucagauggaaaaacaugccuagcauuagauggacaccaacuacuagcaggaggagaaguugaccucaaaaaccaaguaacgcccuuagauauauuaaguaaaacucgaguuagugaggacaacauaacagaaagucaacacauguuaguggcugaaauaaugguaagugaucaagacgauugugcaccaguaggauguucaauguaugcacgcuguaucucagaaggcgaagaugcaacuugccaaugccuaaaaggcuucgcgggcgauggaaaacuauguucagacauagaugaaugugaaauggguguuccuguaugucccccagcguccucaaaaugcauaaauaccgaaggcggcuauguaugucguuguucagaaggguaccaaggugauggaauccauuguuuagauauagacgaaugucaauuaggcgaacauaguuguggugagaacgcuucuugcaccaacacagaaggagguuacacauguaugugcgcagggaggcuaagugagccaggauuaauuuguccagauaguacaccaccuccccaccuaagagaggaugaucaucauuacucaguaagaaauucagauagugaauguccauuaucucacgaugguuacugccuacaugacgguguaugcauguauauagaagccuuagauaaauaugcuuguaacuguguagucggcuacauaggagaaaggugucaauauagggaccuaaaauggugggaauuacgacaugcuggccaugggcaacaacaaaaaguaauaguuguagcagucugugucguaguucuaguaaugcuccucuuacuaucccuauggggugcucauuauuaccgaacgcaaaaacuucugaguaaaaauccuaaaaauccauacgaagaaucaucaagagauguacgaucaaggagaccagccgauacagaagaugggaugucgucuugcccacagccaugguucguuguaauaaaagaacaccaagauuugaaaaacggaggucaaccugucgcaggagaggauggacaagcugcagaugguaguaugcaacccacaaguuggagacaagaaccccaauuaugcggaaugggaacggaacaagggugcuggauuccaguaucgagcgacaaagggucuugcccccaaguaauggaaagaucguuccauaugcccucauacggaacgcaaacuuuagaaggaggaguagagaaaccacauuccuuacuaagcgcaaauccauuauggcaacaacgagcuuuagauccaccacaucaaauggaauugacacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3651 - RNA, 892 nt, Artificial Sequence
  mRNA product Design2 comprising derived and/or modified sequence from Homo sapiens__NP_001423.1__HsEREG (opt12)
ggggcgcugccuacggagguggcagccaucuccuucucggcaucaagcuuaccaugacagcaggaagaagaauggaaaugcuaugugcaggaagaguaccagcacuauuacuaugucuaggauuccaucuauuacaagcaguauuaaguacaacaguaauaccaagcuguauaccaggagaaagcucagacaauugcacagcauuaguacaaacagaagacaauccaagaguagcacaaguaagcauaacaaaaugcucaagugauaugaauggauauugcuuacacggacaauguauauaucuaguagacaugagccaaaacuauugcagaugcgaaguaggauacacgggaguaagaugugaacacuucuuucuaacaguacaucaaccacuaucaaaagaauacguagcauuaacaguaauauuaauaauacuauuucuaauaacaguaguaggaagcacauacuauuucuguagaugguacagaaacagaaaaucaaaagaaccaaaaaaagaauaugaaagaguaacaucaggagauccagaacuaccacaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3652 - RNA, 850 nt, Artificial Sequence
  mRNA product Design2 comprising derived and/or modified sequence from Homo sapiens__NP_000791.1__HsFGF1 (opt12)
ggggcgcugccuacggagguggcagccaucuccuucucggcaucaagcuuaccauggcagaaggagaaauaacaacauucacagcacuaacagaaaaauucaaccuaccaccaggaaacuacaaaaaaccaaaacuacuauacugcucaaacggaggacacuucuuaagaauacuaccagacggaaccguagacggaacaagagacagaucagaccaacacauacaacuacaauuaucagcagaaucaguaggagaaguauacauaaaauccacagaaacaggacaauacuuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaucaugcaaaagaggaccaagaacacacuacggacaaaaagcaauacuauuccuaccccuaccaguauccucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3653 - RNA, 1249 nt, Artificial Sequence
  mRNA product Design2 comprising derived and/or modified sequence from Homo sapiens__NP_001997.5__HsFGF2 (opt12)
ggggcgcugccuacggagguggcagccaucuccuucucggcaucaagcuuaccaugguaggggugggaggaggagacguagaagacguaacaccaagaccaggaggaugucaaauaaguggaagaggagcaagagguuguaauggaauaccaggagcggcagcaugggaagcagcauuaccgagaagaagaccgagaagacacccaaguguaaauccuagaucaagagcagcuggaagcccaagaacacgaggaagaagaacagaagaaaggccuaguggaaguagauuaggggacagaggaagaggaagagcauugccaggaggaagacuaggcggaagaggaagaggaagagcaccagaaagaguaggagguagaggaagaggaagaggaacagcagcaccaagagcagcaccagcagcaaggggaaguagaccaggaccagcgggaacaauggcagcaggaaguauaacaacacuuccagcauugccagaagauggaggaaguggcgcauuuccgccaggacauuuuaaagauccaaagagauuauacuguaaaaauggagguuuuuuuuuaagaauacauccagauggaagaguagauggaguaagagaaaaaagugauccacauauaaaauuacaauuacaagcagaagaaagaggaguaguaaguauaaaaggaguaugugcaaacagauauuuagcaaugaaagaagauggaagauuacuagcaaguaaauguguaacagaugaauguuuuuucuuugaaagauuagaaaguaauaauuauaauacguaccgaaguagaaaauauacaaguugguauguagcguuaaaaagaacaggacaauauaaauuaggaagcaaaacaggaccgggacaaaaagcaauauuauuuuuaccuaugagugcgaaaaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3654 - RNA, 967 nt, Artificial Sequence
  mRNA product Design2 comprising derived and/or modified sequence from Homo sapiens__NP_002000.1__HsFGF7 (opt12)
ggggcgcugccuacggagguggcagccaucuccuucucggcaucaagcuuaccaugcacaaauggauacuaacauggauacuaccaacacuacuauacagaagcugcuuccacauaauaugcuuaguaggaacaauaagccuagcauguaacgauaugacaccagaacaaauggcaacaaauguaaacugcagcucacccgaaagacacacaagaucauacgacuacauggaaggcggagacauaagaguaagaagacuauucugcagaacacaaugguacuuacgaauagacaaaagaggaaaaguaaaaggaacacaagaaaugaaaaacaacuacaacauaauggaaauaagaacaguagcaguaggaauaguagcaauaaaaggaguagaaucagaauucuaccuagcaaugaacaaagaaggaaaacuauacgcaaaaaaagaaugcaacgaagacugcaacuucaaagaauuaauacuagaaaaccacuauaacacauacgcaagcgcaaaauggacacacaacggaggagaaauguucgucgcacuaaaccaaaaaggaauaccaguaagaggaaaaaaaacaaaaaaagaacaaaaaacagcacacuuccuaccaauggcaauaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3655 - RNA, 1009 nt, Artificial Sequence
  mRNA product Design2 comprising derived and/or modified sequence from Homo sapiens__NP_001936.1__HsHBEGF (opt12)
ggggcgcugccuacggagguggcagccaucuccuucucggcaucaagcuuaccaugaaacuacuaccaagcguaguacuaaaacuauucuuagcagcaguacuaagcgcacuaguaacaggagaaagccucgaaagacuacgaagaggccuagccgcagguacaucaaacccagacccaccaacaguaucaacagaccaauuacuaccacuaggaggaggaagagacagaaaaguaagagaccuucaagaagcagaccuagaucuacuaagaguuacauuaucaucaaaaccacaagcacuagcaacaccaaacaaagaagaacacggaaaaagaaaaaaaaaaggaaaaggacuaggcaaaaaaagagacccaugcuuaagaaaauacaaagacuucugcauacacggagaaugcaaauacguaaaagaacuaagagcaccaucaugcauaugccacccaggauaucacggagaaagaugccacggauuaagccuaccaguagaaaauagacuauacacauacgaccacacaacaauacuagcaguaguagcaguaguacuaucaucaguaugucuacuaguaauaguaggacuauuaauguucagauaccacagaagaggcggauacgacguagaaaacgaagaaaaaguaaaacuaggaaugacaaauucacacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3656 - RNA, 2569 nt, Artificial Sequence
  mRNA product Design2 comprising derived and/or modified sequence from Homo sapiens__NP_000592.3__HsHGF (opt12)
ggggcgcugccuacggagguggcagccaucuccuucucggcaucaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3657 - RNA, 2308 nt, Artificial Sequence
  mRNA product Design2 comprising derived and/or modified sequence from Homo sapiens__NP_005336.3 __HsHSPA1A (opt12)
ggggcgcugccuacggagguggcagccaucuccuucucggcaucaagcuuaccauggcaaaagcagcagccauaggaauagaucuugguacaacauauucaugcguaggcguauuucaacauggaaaaguagaaauaauagcaaacgaccaaggcaaccgaacaacaccauccuacguggcuuucacagacacagaaagacuaauuggcgaugcagcuaaaaaucaaguugcauuaaauccacaaaacacaguauuugacgcaaaaagacucauaggaagaaaauuuggggauccuguaguccaaagcgauaugaaacacuggcccuuucaaguaauaaacgacggcgacaaaccaaagguacagguaaguuauaagggagaaacaaaagcauuuuaccccgaagaaaucagcagcaugguauuaacuaaaaugaaagaaauagccgaggcauauuuaggauauccaguuacaaacgcagucauaacuguaccagcauacuuuaaugauucacaaaggcaagcaacaaaagaugcaggaguaauagcuggauuaaacguauuaagaauaauaaacgaaccaacagcagcagcaauagcguaugguuuagaccgaacaggcaaaggagagagaaacguacuaaucuuugaucuaggaggaggaacauucgauguaucaauauuaacaaucgaugacggaauauucgaaguuaaagcaacugcaggagacacacacuuaggaggagaagauuuugauaacagauuaguaaaccacuuuguagaagaauuuaaacgaaaacauaagaaagacauuucacaaaauaaaagggcuguaagaagacuaagaacagcuugcgaaagagcuaaaagaacacuaagcagcucaacacaagcaagucuagaaauagacaguuuauuugaaggaaucgauuucuacacaucaauaacaagagcacgauuugaagaacuauguagugaccuauuuagaagcacucuagagccugucgaaaaagcauuaagagaugcuaaauuagacaaagcacaaauacacgaucuaguucuaguaggaggaucaacucgaauccccaaaguacaaaaacuauuacaagauuucuucaaugguagagaccucaauaaaaguauuaauccagaugaagcagucgcauauggugcugcaguacaggccgcaauuuuaaugggggauaaauccgaaaacguccaagaucuauuauuauuagacguagcaccauuaucacuagguuuagaaacagcuggagggguaaugacugcauuaauaaaaaggaacaguacaauaccgacaaaacaaacacaaauauuuacaacauacucagauaaucaaccaggaguuuuaauucaaguauacgagggagaacgcgcaaugacaaaagacaacaaucucuuaggccgguuugaacuaucagguauaccuccagccccuagagguguuccacaaauagaaguaacauuugauauugacgcuaaugguauccuaaacgucacagcaacugacaaaucaaccggaaaagcaaauaaaaucacaauaacaaaugauaagggaagacuuaguaaagaagaaaucgaaagaaugguacaagaggcagaaaaauauaaagcggaagacgaaguacaaagagaaagaguaagugcuaaaaacgcgcuugaauccuaugcauucaauaugaaaucagcagucgaggacgaaggauuaaaaggaaaaauaagugaagcagacaaaaagaaaguuuuagauaaaugccaagaaguuauuucaugguuagaugcaaauacauuagcagaaaaagacgaguucgaacauaaaaggaaagaacuagaacaaguauguaauccuauaauaagcggauuauaccaaggugcgggagguccaggacccggugguuucggugcucaaggaccuaaaggcggcaguggaaguggaccaacuauagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3658 - RNA, 2308 nt, Artificial Sequence
  mRNA product Design2 comprising derived and/or modified sequence from Homo sapiens__NP_005337.2 __HsHSPA1B (opt12)
ggggcgcugccuacggagguggcagccaucuccuucucggcaucaagcuuaccauggcuaaagcagcagcaaucggaaucgauuuagggacaacauacagcuguguaggaguauuccaacacggaaaaguugaaauaauagcaaaugaucagggaaacaggacaacuccuagcuauguugcauuuaccgauaccgaacgucucauuggagaugcggcaaaaaaucagguagcauuaaacccccaaaacacaguauuugacgcuaaaagauuaauaggacgaaaauucggagauccgguuguacaaagcgacaugaaacacuggccauuucaaguaauaaaugauggagacaaaccaaaaguccaagucucuuacaaaggagaaacaaaagcauucuacccagaagaaauaucaaguauggucuuaaccaaaaugaaagaaauagcagaagcauacuuaggguacccaguaacaaaugcaguaauaacaguucccgcauauuuuaacgauagccaaagacaagcuacuaaagacgcaggaguaaucgcaggauuaaauguacuuagaauuauaaaugagccaacugcagcagcaauugcauauggauuggacaggacuggaaaaggagaaagaaacguauuaauauuugaccuaggaggaggcacauuugacguaucaauauuaaccauagacgacggaauauucgagguaaaagcaacagcaggagacacccauuuaggaggagaagauuucgauaaucgauuaguaaaucauuuuguagaagaauuuaaaagaaaacauaaaaaagauauaucacaaaauaaaagagcaguuagacgauuacgaacagcuugcgaaagagcaaaaagaacccuaaguucuagcacacaagcuagccuugaaauugauucccuauuugaaggcauagauuucuauacaagcaucacucgagcaagauuugaagaauuaugcagugacuuauuuagaucaacucuagaaccuguagaaaaagcgcuuagagacgccaaauuagauaaagcacaaauccaugauuuagucuuaguaggaggaucaaccagaauacccaaaguacaaaaacuauuacaagacuucuucaacggaagagaucuaaauaaaucaauaaauccugacgaggcaguugccuacggagccgcgguacaagcagcaauacuaaugggagacaaaagcgaaaacguacaagaucuauuacuucuagauguagcaccucuaaguuuaggauuagaaacagcaggaggaguaaugaccgcacuaauaaaaaggaauucaacgauaccaacaaaacaaacucaaauuuucacaacauacucagacaaucaaccuggaguacuaauacaaguauacgaaggagagagagcaaugacaaaagauaacaaucuauugggaagauucgaacuaucaggaauacccccggcgccacgaggaguaccgcaaauugaaguaacuuuugauauagaugccaauggaauauuaaauguaaccgcaaccgauaaaagcacuggaaaagcaaauaaaauaacaauaacaaaugacaaaggaagacuaucaaaagaagaaauagaacgaaugguccaagaagcagaaaaauacaaagcagaagacgaaguacaacgagaacgaguuucagccaaaaaugcauuagaaucauacgcauuuaacaugaaaagugcaguagaagacgaaggacuaaaaggaaaaaucucagaagcagauaaaaaaaaaguacuggauaaaugucaagaagucauaaguugguuagacgcaaauacauuagcagaaaaagacgaauucgaacacaaaagaaaagagcuagaacaagucuguaacccuauaauaaguggacuauaccaaggagcgggaggaccaggaccaggagguuuuggugcacaagguccaaaaggcggaagcggcagcggaccuacaauagaagaaguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3659 - RNA, 2308 nt, Artificial Sequence
  mRNA product Design2 comprising derived and/or modified sequence from Homo sapiens__NP_005518.3 __HsHSPA1L (opt12)
ggggcgcugccuacggagguggcagccaucuccuucucggcaucaagcuuaccauggcuacagcaaaaggaauagcuauuggaauagaucuaggcacaacauacaguugcguuggcguuuuucagcauggaaaaguagaaauuauagcaaaugaucaaggaaaucgcaccacuccuucuuauguagcuuucacagauacagaacgacuuauaggagacgcugcuaaaaaccaaguugcaaugaacccacaaaauacugucuuugacgcaaaaagacuaauaggccgaaaauucaaugacccaguaguacaagcggacaugaaacuuuggccauuccaagugaucaacgaaggugguaaaccaaaaguauuaguaucauacaaaggagaaaauaaagcauuuuacccagaagaaauaagcucuaugguacugacuaaauuaaaagaaacagcagaagcauuucuaggacacccaguaacaaaugcaguaauaacaguacccgcuuacuuuaaugacucccaaagacaagcaacaaaggacgcaggaguuauagcaggacuuaauguacuuagaauaaucaacgaaccaacagcggcagcaauagccuauggauuagauaaaggaggacaaggagaacgacauguauuaauauuugaccuagguggagguacauucgaugucucuauauuaaccauagacgacggaauauucgaaguaaaagcaacagcaggggacacucauuuaggcggagaagauuuugacaauagauuaguaagccacuucguagaagaguucaaaagaaaacacaaaaaggauauaagucagaauaaacgagcaguaagaagacuacgaacagccugugaaagagcuaaaagaacguuaucaaguucaacacaagcaaaucuagaaauagacagucuauaugaaggaauagauuucuauaccucaauaacgagagcuagauuugaagaacuaugcgcagaucuauucagaggcacacuagaaccaguagaaaaagcucuacgagaugcaaaaauggacaaagcuaaaauucaugauauaguccuuguagggggaucaacaagaauaccaaaaguacaaagauuguuacaagauuacuuuaacggaagagauuuaaacaaaucaauaaacccagaugaagcuguagcauauggcgcagcaguacaagcagcaauacuuaugggagauaaaagugaaaaaguacaagauuuauuauuauuagacguagcaccacuaucccuaggacuagaaacagcaggaggaguaaugacagcacucauaaaaagaaauaguaccauaccaacaaaacaaacccaaauauuuacaacguauagcgacaaucaaccaggaguacuaauacaaguguaugaaggagaaagagcaaugaccaaagauaauaaucuucuuggccgauucgaucucacaggaauaccuccagcaccaagaggagucccacaaauugaaguuacauuugacauagacgccaaugguauacuaaacguaacagcuaccgauaaaaguacaggaaaaguaaacaaaaucacaaucacaaaugacaaagguagauuaucaaaagaggaaaucgaaagaaugguauuggacgcagaaaaauauaaagcagaagacgaaguacaaagagagaaaauagcagcuaaaaacgcucuugaaucauaugcauuuaacaugaaaucaguaguauccgacgaaggacucaaaggaaaaauaagcgaaucagauaaaaauaaaauacucgauaaaugcaacgaacuauuaagcugguuagaaguaaaucaacuagcagaaaaagaugaauuugaccauaaaagaaaagaacuagaacaaauguguaauccaauaauaacuaaauuauaccaaggaggaugcacaggaccagccuguggcacaggauauguuccuggacgacccgcaacuggaccaacaauagaagaaguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3660 - RNA, 2302 nt, Artificial Sequence
  mRNA product Design2 comprising derived and/or modified sequence from Homo sapiens__NP_068814.2 __HsHSPA2 (opt12)
ggggcgcugccuacggagguggcagccaucuccuucucggcaucaagcuuaccaugagcgcaagaggaccagcgauuggaaucgaucuaggaacaacguacaguugcgugggaguauuccaacauggaaaaguugaaauaaucgcaaaugaucagggaaauagaacuacaccaucauacguugcuuuuacagacaccgaaagauugauuggagacgcagcgaaaaaucaaguagcaaugaauccaaccaacacaaucuuugacgcaaaaagacucauaggcagaaaauucgaagacgcaacgguacagagcgauaugaaacacuggccauuuagaguaguaucagaaggaggaaaaccaaaaguacaagucgaauauaaaggagaaacuaaaacauuuuucccagaagaaauaagcaguaugguauuaacaaaaaugaaagaaauagcagaagcauaucuaggaggaaaaguucauagugcaguaauaacuguaccagcauauuuuaaugauucacaaagacaagccacgaaagaugccggaacaauaaccggauuaaauguacugagaauaauaaacgaaccaacagcugccgcaauagcauacgggcuagauaagaaaggaugugccggaggugagaaaaauguauuaauauuugacuuaggcggaggaacauuugauguaucaauacuaacaauugaagacggaauauucgaaguuaaaaguacggcgggagauacacauuuaggaggagaagauuuugauaacagaaugguaagucauuuagcagaagaguucaaacgaaaacacaagaaagacauaggaccuaauaaaagagcaguaagaagacuaaggacugcaugcgaaagagcaaaaagaacacuaaguagcaguacacaggcgaguauagaaauagacucauuauaugaaggagucgauuuuuauacuucaauaacgagagcaagauucgaagaacucaaugcggauuuauuuagaggaacauuggaaccaguagaaaaagcacuuagagaugcaaaacuagacaaaggacaaauccaagaaauaguccuaguagguggcucaacaagaauaccaaaaauccaaaaacuauugcaagauuucuucaauggcaaagaauuaaauaagucaaucaauccagacgaagcagucgcauacggagcagcaguucaagcagcaauauugauaggggauaaaucagaaaauguacaagaccuauuauuguuagauguaacaccauuaagucucgguauagaaacugcaggaggaguaaugacaccucuaauaaaaagaaacacaacuauaccaacaaaacaaacacaaacauuuacaacauacagugacaaucaaucaaguguauuaguacaaguauacgaaggagaaagagcaaugacgaaagacaacaaucuauuaggaaaauuugaucuaacagggauuccuccagcaccgagagguguaccacaaaucgaaguaacauuugacauagacgcaaauggaauauuaaacguaacagcagcagauaaaucaaccgggaaagaaaacaaaaucacaauaacuaacgauaaagggagguuaagcaaagaugauaucgaucguaugguccaagaagcagaaagauauaaaagcgaggaugaggcaaacagagacagaguagcagcgaaaaaugcauuagaaucuuacacguauaauauaaaacaaacuguagaggacgaaaaauuacggggaaaaauauccgaacaagauaaaaacaaaauauuagauaaaugccaagaagucauaaacugguuagacagaaaucaaauggcagaaaaagaugaauacgaacauaaacagaaagaacuagaaagaguguguaaucccauaauaucaaaauuauaccaaggagguccaggagguggaagcgggggaggaggaaguggcgcaagcggagggccaacaauagaagaaguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3661 - RNA, 2905 nt, Artificial Sequence
  mRNA product Design2 comprising derived and/or modified sequence from Homo sapiens__NP_002145.3 __HsHSPA4 (opt12)
ggggcgcugccuacggagguggcagccaucuccuucucggcaucaagcuuaccaugucuguaguaggaauagaccucggauuucaaaguuguuauguagcagucgcucgggcaggaggcauugaaacaauugcaaaugaauacucagacagguguacaccagcaugcauaaguuucggaccaaaaaaccgaucaauaggcgcagcagcaaaaagccagguaauaucaaaugcuaaaaauacaguacaaggguuuaaaagauuccacggaagagcauuuucagauccuuuuguagaagcugaaaaaaguaauuuagccuacgacauaguucaguuaccaacaggauuaacaggcauaaaaguaacuuauauggaagaagaacgaaacuuuacaacugaacaaguaacagcaaugcuacuaucuaaauuaaaagaaacugcagaaaguguuuuaaaaaaaccaguaguagacuguguaguaagcgugccauguuuuuauacagacgcggaaagaagaucggucauggaugcaacacaaauagcagggcucaauugccuuaggcucaugaaugaaacaacugcaguagcucuagcuuacggaauuuauaaacaagacuugccagcacuagaagagaaaccaagaaacgucguuuucgucgauaugggacacucagcauaccaaguaaguguuugcgcauuuaauagaggaaaacuaaaaguauuggcaacagcauuugacacaacacuaggagguagaaaauucgaugaaguacuagucaaucacuuuugugaagaauucggaaaaaaguacaaacuagauauuaaaucaaaaauuagagcauuauugcgacuaagccaagaaugugaaaaacuaaaaaaauuaaugucagcaaaugcaucugacuuaccauuaagcauugaaugcuuuaugaaugauguagaugucucaggaacaaugaaucgaggaaaauucuuagaaauguguaacgaucuacuagcuagagucgaacccccucucaggucagugcuagaacaaacaaaacuaaaaaaagaagauauauacgccguggaaaucguagguggagcuaccagaauaccagcugugaaagagaaaauaaguaaauucuucggcaaagaauuaucaacaacacuaaaugcagacgaagcaguuacccgaggaugugcuuuacaaugugcaauuuuaucgccagcauucaaaguacgagaauucucaauaacagauguaguaccuuaucccauaucucuuagauggaauucaccagcagaagagggaagcucagauugcgaaguauuuucaaaaaaccacgcugcaccguuuuccaaaguacugacuuucuacagaaaagaaccauuuacguuagaagcauacuauucaucuccccaagacuuaccauacccagaucccgccauugcacaauucucaguacaaaaggugaccccacaauccgacggauccagcucaaaagugaaaguaaagguaagaguaaauguacacggcauauuuucaguaaguucagcgucccucguagaaguucacaaaagcgaagaaaacgaagaaccaauggaaacagaccaaaacgcaaaagaagaagaaaaaaugcaaguagaccaagaagaaccccauguagaagaacaacaacaacaaacacccgcagaaaacaaagccgaaagugaagaaauggaaacaucacaagcaggcaguaaagauaagaaaauggaucaaccaccacaggcaaaaaaagcuaaaguaaaaacaaguacaguagaucucccaauugaaaaucaacuacuauggcaaaucgauagagagauguuaaaccuauacaucgaaaaugaaggaaaaaugaucaugcaagacaaacuagaaaaagaacggaacgaugcaaaaaacgcaguggaagaguauguauaugaaaugcgagacaaacuaucaggagaauaugaaaaauuuguuagcgaggaugacagaaauucauucaccuuaaaacuagaagauacugaaaauugguuauaugaagacggagaagaccaaccuaagcaaguguacguugauaagcuagcagagcucaaaaauuugggccagccaauaaaaauaagauuccaagaauccgaagaaagaccgaaacuauucgaagaacuugggaaacaaauacagcaauacaugaagauaaucucaucauuuaaaaacaaagaagaucaauacgaccacuuagacgcagcagacaugacuaaaguagaaaaaucuacgaacgaagcaauggaauggaugaauaacaaacuaaaucuucaaaacaaacaaucacuuacaauggacccaguaguaaaaagcaaagaaaucgaagcgaaaauaaaagaauuaacgagcacauguucaccuauaauaucaaaaccaaaaccaaaaguggaaccaccuaaagaagaacaaaaaaaugcagaacaaaauggaccgguagacgggcaaggagacaauccaggaccucaagcagccgaacagggcacagacacagcaguaccaucagacagcgacaaaaaacuaccggaaauggacauagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3662 - RNA, 2902 nt, Artificial Sequence
  mRNA product Design2 comprising derived and/or modified sequence from Homo sapiens__NP_055093.2 __HsHSPA4L (opt12)
ggggcgcugccuacggagguggcagccaucuccuucucggcaucaagcuuaccaugagugugguaggaauagaccuuggauuccuaaauugcuacauagcuguagcaagaucaggaggcauugaaacaauagcaaacgaauauagcgaccgaugcacaccagcaugcauaucauuaggaaguaggacuagagccauagguaaugcggcaaaaucacaaauaguaaccaauguaagaaacaccauacauggauucaagaaacuacacggacgcagcuucgacgauccaauaguacaaacagaaagaauuagacuacccuacgaacuacagaaaaugccaaacggaucugcaggagucaaaguaagauaccuugaagaagaacggccauuugcaauugaacaagugacaggaauguuacuugcaaaacuaaaagaaacaagugaaaaugcauuaaagaaaccaguagcagauugcguaauuucaauacccagcuucuucacagacgcagaaagaagaaguguaauggcagcagcacaaguagccggacuaaacugucuaagacuaaugaacgaaacaacagcuguagcuuuagcauacggcauauauaaacaagaucuaccaccacuagaugaaaaaccaagaaacguaguuuuuauagauaugggacacucagccuaccaaguccuaguaugugcuuucaacaaaggaaaauuaaaaguacuugcaacaacauuugauccauaucuaggggguagaaauuucgacgaagcucuaguagacuacuuuugugaugaguucaaaacaaaauacaaaauuaaugucaaagaaaauucaagagcauuacucagacuuuaccaagaaugcgaaaaauuaaagaaacuaaugucugcaaaugcauccgauuuaccgcuaaauaucgaaugcuuuaugaaugaucuugacguaucaagcaaaaugaacagagcacaauuugaacaacuaugugcauccuuauuagcaagaguagaaccuccccuaaaagcgguaauggaacaagcuaaucuccaacgcgaagacauaagcucaauagaaauaguaggcggagcaaccagaauaccggcagugaaagaacaaauaacaaaauuuuucuuaaaagacauuucuacaacuuuaaacgcagacgaagcuguggcuagagguugcgcacuucaaugcgccaucuuaucaccagcguucaaaguccgcgaguucaguauaacagaccugguaccauacaguaucacgcuccgauggaaaacuagcuuugaagacggcucuggggaaugcgaaguauucuguaaaaaucacccagcaccauuuagcaaaguaauaacauuucacaagaaagaaccauucgaacuagaagcauucuacacaaacuuacaugaaguucccuacccagaugcacgaauagguaguuucacaauacaaaauguauucccacaauccgacggagacucaucuaaagucaaagucaaagugcggguaaacauacauggaauauucuccguugcaagugcaagugugauagaaaaacaaaaccucgaaggggaucauucagacgcaccuauggaaacggaaacaaguuucaaaaacgaaaacaaagauaauauggacaaaaugcaaguagaucaagaagaaggacaccaaaaaugccaugcggaacauacucccgaagaagaaauagaucauacaggugcuaaaacaaaaucagcaguauccgacaaacaagacaggcuaaaucaaacacucaagaaaggaaaaguaaaaaguauagaccugccgauacaaagcagucucugucgacaauuaggacaagauuuacuaaauaguuacauagaaaaugaagggaaaaugauuaugcaagauaaauuagaaaaagaaaggaacgaugccaaaaaugcuguugaagaauacguauaugacuuucgcgacagauuaggaacaguauacgaaaaauuuauaacccccgaagaccuaaguaaacuaucugcaguacuagaagacacagaaaauugguuauaugaagauggagaagaucagccaaaacaaguuuacguagauaaacuacaagagcuuaagaaauacggacaaccaauucaaaugaaauauauggaacaugaagaacgcccgaaagcauuaaacgacuuaggaaagaaaauacaauuaguaaugaaaguaauagaggccuacagaaacaaagaugaaagguaugaccaccucgaucccacagaaauggaaaaaguugaaaaaugcauaucagacgcuaugucauggcuaaacagcaaaaugaacgcccaaaacaaauuaucacuuacucaggauccuguaguaaaaguaagcgaaauaguagcgaaaagcaaagaacuagacaacuuuuguaacccuauaaucuauaaaccuaaacccaaagcagaaguaccagaggauaaacccaaagccaauucugaacauaaugggccaauggauggacaauccggcacagaaacaaaaucggacaguaccaaagacucaucacagcacacaaaaagcaguggagaaauggaaguugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3663 - RNA, 2347 nt, Artificial Sequence
  mRNA product Design2 comprising derived and/or modified sequence from Homo sapiens__NP_005338.1__HsHSPA5 (opt12)
ggggcgcugccuacggagguggcagccaucuccuucucggcaucaagcuuaccaugaaacucucacuaguagcagcgauguuauuacuuuuaagugcugcacgagcagaggaagaagauaaaaaagaagacguagguacaguaguagguauagaccuaggaacaacauacucauguguaggaguauucaagaauggacgaguagaaauuauagcaaaugaucaaggcaauagaauaacaccaaguuauguagcuuucacacccgaaggagaaagauuaauaggggacgcagcuaaaaaccaauuaacaagcaauccagagaacacaguauuugacgcaaaaagauuaaucggcagaacauggaaugaccccucuguacaacaagauauuaaauuucuaccguuuaaagugguagaaaaaaaaacaaaaccuuauauacaaguagacauaggaggaggacaaacgaaaacauucgcuccagaagaaauaagcgcaaugguuuuaacuaaaaugaaagaaacagcggaagcauauuuaggaaaaaaaguaacucacgcuguaguaacagucccagcauacuuuaacgaugcucaaagacaagccacaaaagaugcaggaacaauugcaggcuuaaauguaaugagaauaauaaaugaaccuacagcagccgcaauagcguacggacuagacaaaagagaaggcgaaaaaaacauacuaguauuugauuuaggaggaggaacauucgauguaagucuacuuacaauugacaacggagucuuugaaguaguagccacaaauggagauacgcaucuaggaggagaggacuucgaccaaaggguuauggaacacuucauaaaauuauacaaaaaaaaaacaggaaaagacguuagaaaagacaauagagccguacaaaaauuaagacgagagguagaaaaagcaaaaagagcauugucaagccaacaccaagcaagaauagaaauagaaucauuuuaugaaggagaggacuucagcgaaacacuuacaagagcaaaauuugaagaacugaauauggauuuauuuagaaguacaaugaaaccaguucaaaaagucuuagaagauagugauuuaaaaaaaagcgacauagaugaaauaguacucguaggaggaucaacaaggauaccaaaaauacaacaauuaguuaaagaguuuuuuaauggaaaagaaccaucacgaggaauaaauccagacgaagcaguagcauacggagcagcaguacaggcaggaguacuaagcggagaucaagauacaggagaucuagucuuacuagaugucugcccacuuacauuaggaaucgaaaccguaggagggguaaugacaaaacuaauaccacguaacacgguugugccaacaaaaaaaucacagauauucaguacagcgucagacaaucagccaaccgucacuauaaaaguauacgaaggagaacgaccacuuacaaaagauaaccaucuacuaggaaccuucgauuuaacaggaauaccacccgccccaagaggaguaccacaaauagaaguuacauucgaaauagacguaaacgguauucuuagagugacagcugaagacaaaggaaccggaaauaaaaauaaaauaacaauaacuaacgaucaaaaccgacuaacuccagaagaaauagaacgcaugguaaacgaugcagaaaaauuugcagaagaagacaaaaaacuaaaagaacgaaucgauacuagaaaugaacuagaaucauacgcauauucauuaaaaaaucaaauaggcgacaaagaaaaacuaggaggaaaauuaucaagugaggauaaagaaacuauggaaaaagcggucgaagaaaaaauagagugguuagaaagucaucaagacgcugauauagaagauuuuaaagcaaaaaaaaaagaauuagaagagauaguacaaccaauaauaucaaaacuauauggaagcgccgguccuccaccaacaggcgaagaagacacagcugaaaaagacgaauuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3664 - RNA, 2314 nt, Artificial Sequence
  mRNA product Design2 comprising derived and/or modified sequence from Homo sapiens__NP_002146.2__HsHSPA6 (opt12)
ggggcgcugccuacggagguggcagccaucuccuucucggcaucaagcuuaccaugcaagccccaagagaauuagcaguuggaauagaccuagguacaacauacucauguguaggaguuuuucaacaaggaagaguugagauacuagcaaaugaucaaggaaacagaacaacacccagcuauguagcauucacugacacagaaagauuagucggagacgccgcaaaaucacaagcagcucuaaacccucauaauacaguuuuugaugcuaaaaggcuuauagggagaaaauucgcagacacaacaguacaaucagauaugaaacacuggcccuuucgaguaguaucagaaggaggaaaaccgaaaguaagaguuugcuauagaggagaagauaaaacauuuuacccagaagaaaucucaucaaugguucuuaguaagaugaaagagacagcggaagcauacuuaggacaaccggucaaacacgccguuauaacaguaccugcauauuucaaugacagucaaagacaagcuacaaaagaugcaggagcaauagcaggauuaaauguauuaagaauuauuaaugaaccaacagccgcagcaauagcauacggacuagaucguagaggagccggagaaagaaacgucuuaauauuugauuuaggagggggaacauuugauguaucaguucuaucgauagaugcaggaguauuugaaguaaaagcuacagcaggagauacacauuuaggcggggaagauuuugauaacagauuaguaaaucacuucauggaagaauuuagaagaaaacacgguaaggacuuaucaggaaauaaacgagcacucagaagacuuagaacagccugugaacgagcaaaacguacuuugagcucaaguacacaagcuacuuuagaaauagacaguuuauucgaagguguugauuuuuacacaaguauuacuagagcaagauuugaagaacuauguucagauuuauuucguucaacauuagaaccaguagaaaaagcacuaagagaugcaaaacuagauaaagcucaaauacaugauguggugcuaguaggagguuccacaaggaucccaaaaguccaaaaacuacuacaagauuucuuuaauggcaaagaacucaacaaaaguauaaaucccgaugaagcaguagcauauggugcagcaguacaagcagcaguuuuaaugggagauaagugugaaaaaguacaagauuuacuauuacuagacguagcaccccuaucacucggacuagaaacagcuggaggaguaaugacuacacuaauucaaagaaacgccacaaucccaacaaaacaaacacaaacauuuacaacauacucagauaaucaaccaggcguauuuauacagguuuacgaaggugaacgagcaaugaccaaagacaauaaucuacucgguagauucgaacuaaguggaauaccaccagccccaagaggaguaccacaaauagaaguaacauuugauauagaugcaaaugguauucucagcguaacugcaaccgaccguagcacaggaaaagcuaacaaaauaacuauaacgaaugauaaaggaagacuaaguaaagaagaaguagaacgcaugguacaugaagcagaacaauauaaagcagaagacgaagcacaaagagauagaguugcagcuaaaaacaguuuagaagcacauguguuccauguaaaaggaucauuacaagaagaaucauuaagagauaaaauuccagaagaagauagacgaaaaaugcaagauaaaugcagagaaguacucgcauggcuagagcacaaucaauuagcagagaaagaggaauaugaacaccagaaacgagaauuagaacaaauuugucgaccaauauuuaguagguuauacggaggaccaggagucccaggagguucaucauguggaacccaagcaagacaaggagaucccaguacagguccaauaauagaagaaguugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3665 - RNA, 1486 nt, Artificial Sequence
  mRNA product Design2 comprising derived and/or modified sequence from Homo sapiens__P48741__HsHSPA7 (opt12)
ggggcgcugccuacggagguggcagccaucuccuucucggcaucaagcuuaccaugcaagcuccaagagaacuagcuguaggaauagauuuaggaacaacauauaguuguguaggaguauuucaacaaggaagaguugaaauacuagcaaaugaucaagggaauaggacaacaccaucauauguagcauuuacagauacagaacgauuaguaggagaugcagcaaaaucacaggcagcucuaaacccacauaauacaguauuugaugcaaaaagacuaauagguagaaaauuugcagacacuacaguacaaagcgauaugaaacauuggccauuucaaguaguaucagaagguggcaaaccaaaagucagaguauguuauagaggagaagauaaaacuuuuuaucccgaagaaauaucaucaaugguauuaaguaaaaugaaagaaacagcagaagcauaucuaggacaaccaguaaaacaugcgguaauaacaguuccaacauauuuuucaaacucacaaagacaagcaacaaaagaugccggugcaaucgcaggacuuaaaguauuaccaauaauuaaugaagcaacagcagcagcaauagcauauggacuagauagaagaggagcuggaaaaagaaauguauuaauauucgauuuaggagguggaaccuuugauguaucaguauuaagcauagaugcaggaguauuugaagucaaagcaacagcaggagauacacaucuaggaggggaagauuucgauaauagauuaguaaaucacuuuauggaagaguuuagaagaaaacauggaaaagauuuaagcgguaauaaaagagcauuaagaagacuaagaacagcaugcgaaagagcaaaaagaacaccaucaagcaguacgcaagcaacauuagaaauagacucauuauucgaaggaguagacuuuuauaaaucaauaacaagagcgagauucgaagaauuaugcucagacuuauucagaaguacacuagaaccaguagaaaaagcauuaagagaugcaaaacuugacaaagcacaaauacaugauuucguacuaggaggaggauuacacagucauccacaaggagcugaaguagcagcaggacuauuacaacgacaaggugcagaacaagaacaucaaccauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3666 - RNA, 2323 nt, Artificial Sequence
  mRNA product Design2 comprising derived and/or modified sequence from Homo sapiens__NP_006588.1 __HsHSPA8 (opt12)
ggggcgcugccuacggagguggcagccaucuccuucucggcaucaagcuuaccaugucaaaagguccggcaguaggaaucgauuuaggaacaacauauaguugugucggaguauuucaacauggaaaaguugaaauaauagcaaacgaucaaggcaauagaacuacaccaucuuacguugcauuuacagauacagaaagauuaauaggggacgcagcuaaaaaccaaguagcaaugaacccaacaaauacaguauuugacgcaaaacgacuaauaggaagaagauuugaugaugccguuguacaaucugacaugaaacauuggcccuuuaugguaguaaaugacgcaggaagaccaaaaguccaagucgaauacaaaggagaaacaaagagcuuuuacccugaagaaguuucuagcaugguccuaacaaaaaugaaagaaauugcagaagcguaccuaggcaaaaccguaacaaacgcagucgugacaguaccagcauauuuuaacgauucacaaagacaggcaacaaaagacgcaggaacaauugcaggacucaacguacuccgaauaauaaaugaaccaacugcugcagcaaucgcauauggguuagacaagaaaguaggagcagagcgcaauguacuaauauuugaccuaggaggagguacguucgauguaagcauauuaacaauagaagauggcauauuugaaguaaaauccacagcaggagacacacacuuaggaggagaagauuuugacaauagaauggucaaccauuucauugcagaguucaaaagaaaacacaagaaagauauuucagaaaauaaaagagcaguaagaagauuaagaacagcuugugaaagagcuaaaagaacuuuaucaucaucaacacaagcuagcauagaaauugacaguuuauaugaaggaauagauuucuauacauccaucacgcgagcaagguuugaagaauuaaaugcagacuuauuucgaggaacacuugacccuguugaaaaagcccuacgagacgcuaaacuagacaaaagccaaauacaugacauaguucuaguaggaggaagcacuagaauacccaaaauacaaaagcuacugcaagacuucuucaacggaaaggaacucaacaaaagcauuaaucccgaugaagcaguagcuuacggagcugcaguacaagcugcaauauuaaguggagacaaaagcgaaaacguacaagaucuacuauuacuagauguaacaccucuaagccucggaauagaaacggcaggaggagugaugacaguacucauaaaaagaaauacuacaauaccaaccaaacaaacacaaacauuuacaacauacucagacaaucaaccaggaguauuaauacaaguauacgaaggagaaagagccaugacaaaagacaauaaucuccuaggaaaauucgaauuaacaggaauaccaccagcaccucgcggaguaccacaaaucgaaguaaccuuugacauugaugcgaacggcauauuaaauguuucagccgucgacaagucuacaggaaaagagaacaagauaacaauaacuaaugauaaagggcgauuaagcaaagaagauauagaacgaaugguacaagaagcagaaaaauauaaagcagaagaugaaaaacaaagagauaaaguaucuagcaaaaauagccuagaaaguuaugcauucaauaugaaagccacaguugaagacgaaaaauuacaaggcaaaauaaaugacgaagauaaacagaaaauauuagacaaauguaacgaaauaauaaacuggcuggauaaaaaucaaacggccgaaaaagaagaauuugaacaucaacaaaaagaauuagaaaaaguaugcaauccgauaauaacaaaauuauaccaaucagcuggggguaugccaggggguaugccagguggauucccaggagggggagcaccaccaagcggaggagcaagcucaggaccaacaaucgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3667 - RNA, 2422 nt, Artificial Sequence
  mRNA product Design2 comprising derived and/or modified sequence from Homo sapiens__NP_004125.3 __HsHSPA9 (opt12)
ggggcgcugccuacggagguggcagccaucuccuucucggcaucaagcuuaccaugauauccgcaucaagagcagcagcggcaagauuaguaggagcagcagcaaguagaggaccaacagcagcaagacaccaagacaguuggaaugguuuaagccaugaagcauuuagacucgugaguaggagagauuaugcaagugaagccauaaaaggagcugugguaggaauagauuuaggaacaacuaauucauguguugcaguaauggaaggaaaacaggcuaaaguacuagagaaugcggaaggagcuagaaccacucccaguguaguagcauucacagcugauggagaaagauugguagggaugccggcaaaaagacaagcaguuacgaacccaaauaacacauuuuaugcaacaaaacgacuaauagggaggcgauacgaugacccggaaguucaaaaagauauuaaaaacguuccuuuuaagauaguaagagccagcaauggagaugccuggguagaagcccacggaaaguuauauucaccaagucaaauaggggcuuuuguacuaaugaaaaugaaagaaacagccgaaaauuacuuaggacauacugcuaaaaaugcaguuauaacaguaccagcauauuuuaaugauagccaaagacaagcuacaaaagaugcaggucagauaaguggucucaacguucugcgcguaauuaaugaaccaacagcugcugcacuagcauacggguuagauaaaagugaagauaaagucauagcgguauaugauuuaggaggaggcacauuugauauaucaauauuagaaauacaaaaagggguauucgaaguuaaaagcaccaauggagauacguuucuuggaggggaagauuuugaccaagcguuauuaagacauauagugaaagaauuuaagagagagacaggaguagaucuaacaaaagacaacauggcauuacaaagaguuagagaagcugcugagaaggcaaaaugugaauuaagcucaaguguacaaacagauauaaauuuacccuauuuaacaauggauagcaguggaccgaaacaucuaaauaugaaauugaccagagcucaauuugaaggaauagugacagauuuaauaaggagaacaauagcaccaugccagaaagcaaugcaagaugcagaggugaguaaaagcgauaucggagaagugauauugguaggaggaaugacaagaaugccaaaaguacaacaaacaguacaagacuuauuuggcagagcaccaagcaaagcuguuaacccagaugaagcaguggcuauuggagcagcuauacaaggaggaguguuagcaggagauguaacagauguauuauuacuagauguaacaccauuaucauuggguauagaaacacuaggagggguauuuacaaagcuaauaaauagaaauacaacaauaccaacaaagaagucucaaguauucucaacugcagcagaugggcaaacacaaguagaaauaaaaguaugucaaggagaaagagaaauggcaggcgacaauaaacuacuuggacaauuuacacuaauaggcauaccgcccgcccccaggggaguuccacaaauagaaguaaccuucgauauagaugccaacggaauaguacacguaagcgcaaaggacaaagggacagggagagaacaacaaauaguaauacaauccagcggagguuuaucaaaagacgacauagaaaacaugguuaaaaaugcagagaaguaugcagaagaagauagaagaaagaaagaaagaguagaagcaguaaauauggcagaggguauuauacaugauacggaaacaaaaauggaagaauuuaaagaucaauuaccugcagacgaaugcaauaaacuaaaagaagaaauaagcaaaaugagagaauuacuagcaagaaaagauucggaaacuggagaaaauauaagacaagcagcuaguagccugcagcaagccagcuuaaaacuauucgagauggcauauaagaaaauggcaagcgaaagagaaggcagugggagcucaggaacaggugaacaaaaagaagaccaaaaagaagaaaaacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3668 - RNA, 2410 nt, Artificial Sequence
  mRNA product Design2 comprising derived and/or modified sequence from Homo sapiens__NP_079291.2__HsHSPA12A (opt12)
ggggcgcugccuacggagguggcagccaucuccuucucggcaucaagcuuaccauggcugauaaagaagcuggagguucugauggaccacgagaaacagcuccaacuucugcuuacucaaguccagcaaggucuuuaggagacacgggaauuaccccguuaagucccagucauauagucaacgauacugauucuaacguguccgaacaacaaagcuuucuuguaguaguagcaguugacuucggaacuacuucaucaggauaugcguauucauuuacaaaagaaccagaauguauccacgugaugagacgaugggaaggaggagaucccggaguaagcaaucaaaaaacaccgacaacaauacucuuaacaccagaacgaaaauuccauucauuuggcuacgcagcuagagauuucuaucaugaucuagauccaaaugaagcaaaacaaugguuauaucuugaaaaauuuaaaaugaaacuacauacaacaggugaccucacaauggauacugaucuaacagcagcaaaugggaagaaaguuaaagcacuagaaauauuugcauacgcccuucaauacuuuaaagaacaagcacuuaaagaacuaucagaucaagcaggaucugaauuugaaaauagcgauguuagauggguaauaacaguuccagcaauauggaaacaaccagcaaaacaauuuaugcgccaagcugcauaccaagcaggacucgccucuccagagaauucagaacaauuaauaauugcauuagaaccugaagcagccaguauauauugcagaaaacuaagauuacaucaaaugauugaauuaaguaguaaagcagcaguaaacgguuauagugguucagauacaguaggagcuggcuuuacucaagcaaaagaacauauaagaagaaauagacaaucaaggacauuuuuaguagaaaauguaauuggugaaauaugguccgaauuagaagaaggagacaaauauguagucguagacucugguggcggaacuguagaccuaacaguacaucaaauaagacuuccagaaggacaucuaaaagaauuauauaaagcaacgggaggccccuauggaucauuagguguagauuaugaauucgaaaaauuauuauauaaaauauuuggcgaagauuuuauagaacaauucaaaauaaaaagaccugcggcuuggguagacuuaaugauagcuuuugaaucaagaaaaagagcugccgccccagacagaacaaauccauuaaauauaacauuaccauuuucauuuauugauuauuauaaaaaauuuagaggacacucuguagaacaugcacuuagaaaaagcaacguagauuuuguaaaauggaguucucaaggaauguuaagaaugucaccagacgcaaugaacgccuuguucaaaccaacgauugauaguauaauagaacacuuacgcgacuuauuucaaaaaccagaaguaucaacagucaaauuucuauuuuuagucggaggauuugcagaagcaccacuucuacaacaagcaguacaagcagcauuuggagaucaaugcagaaucauaauaccucaagacguaggccucacgauucuaaaaggcgcagugcuauucggucuagauccagcaguuauaaaaguucggcgaucacccuuaacauauggaguuggaguauuaaaucgauacguagaaggaaaacauccaccagaaaaauuauuaguaaaagacgguacgagaugguguaccgauguauucgauaaauuuauaucagcagaccaaucaguagcucucggcgaacucguuaaaagauccuauacaccagcaaaaccaucucaauuaguuauaguaauuaauauauauucaagcgagcacgauaacguuucauuuauaacagauccagguguaaaaaagugcgguacauuaagacucgacuuaaccggaacaaguggaacagcaguuccagcacgcagagaaauacaaacauuaaugcaauuuggugauacugaaauaaaagcaacagccauagacauagccacaucaaaaucaguuaaaguuggaauagacuuucuaaauuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3669 - RNA, 2443 nt, Artificial Sequence
  mRNA product Design2 comprising derived and/or modified sequence from Homo sapiens__NP_443202.3 __HsHSPA12B (opt12)
ggggcgcugccuacggagguggcagccaucuccuucucggcaucaagcuuaccauguuagcaguaccagaaaugggauuacagggacuauauauuggaucuucuccagaaagaucaccaguaccaucaccacccgggucaccaagaacccaagaaagcuguggaauagcuccacuaacaccaucacaauccccuaaaccagaaguaagggcaccccaacaagccaguuucaguguuguaguagcaauagauuuuggaacuacaucaucagguuacgcauuuuccuuugcaucagauccugaagcaauucauaugaugagaaaaugggaaggaggagacccuggcguagcacaucagaaaacuccuacauguuuacuuuugacaccagaaggagcauuucauucauuuggauauacagcacgagauuauuaucacgacuuagauccagaagaagcuagagauuggcucuacuuugaaaaauuuaaaaugaaaauacauagugcaacagaucuaacauuaaaaacccaauuagaagcuguuaaugguaaaacuaugccagcgcuagaaguauuugcgcacgcauuaagauuuuuccgagaacaugcauuacaagaacuuagagaacaaucaccuucacuaccugaaaaagauacaguuagauggguauugacuguaccggcaauauggaaacaaccagcgaaacaauuuaugagagaagcugcauauuuagcuggguuaguaucacgagaaaaugcagagcaacucuuaauugcgcuugagccagaagcagcaucugucuacugcagaaaauuaagacuacaucaacuacuagauuuaaguggcagagcacccggagguggaagacuaggugagcgaagaagcauagauucaaguuuccgacaagcaagagagcaacuaagacgaucaagacacucaagaacauuucuaguagaaagcgguguaggagaauuaugggcagaaaugcaagcaggagaucgauauguaguugccgauugcggggguggcacaguagauuuaacaguccaucaacuagaacaaccacacggaacucuaaaagaacuauauaaagcaucaggagguccauacggcgcaguaggaguggacuuagcguucgaacaacuacuaugcagaauauuuggagaagauuuuauagcgacauuuaaaagacaaagaccugcggccuggguagaucuaacaauagcauucgaagcaagaaaacggacggccgggccgcauagagcaggagcucuaaauauaagccuaccauuuucauuuauagacuuuuauagaaaacagagaggacauaacguugaaacugcacugagacgauccucaguaaauuucguaaaauggucuucacaaggaauguugcgaaugagcugcgaagcaaugaaugaacuauuucaaccaacuguaaguggcauuauucaacauauagaagcacuauuagcaagaccugaaguccaaggaguuaaacugcuauuccugguagguggauuugcagaaucggcaguauuacagcaugcaguacaagcagcuuuaggugcaagaggauuacgaguaguaguaccacaugauguaggacuaacaauuuuaaaaggagcuguacuauucggccaagcuccaggaguuguaagaguuagaagaaguccauuaaccuacgggguagggguacuuaauagauucguaccuggacgacauccaccagaaaaauuauuaguaagggauggaagacgcugguguacagauguguucgaaagauucguagcugcugaacagagcguugcucuaggggaagaaguacgaagaucauacuguccagcuagaccaggccaaaggcgaguauuaauaaauuuauauuguugugcagcagaagaugcaagauucaucacugauccaggaguuagaaaaugcggagcacucucucuagaguuagaaccugcggacuguggacaagacaccgcaggagccccaccaggaaggagagaaauacgagcagcaaugcaauuuggugauacagaaauuaaagucacugcaguagauguaucgacaaauagaucaguaagagcuucgauugauuuccuuucgaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3670 - RNA, 1798 nt, Artificial Sequence
  mRNA product Design2 comprising derived and/or modified sequence from Homo sapiens__NP_008879.3__HsHSPA13 (opt12)
ggggcgcugccuacggagguggcagccaucuccuucucggcaucaagcuuaccauggcucgagaaaugacaauuuuaggaucagcgguauugacacuuuuauuagcaggauaccuagcccaacaauaccuaccacuaccuacaccaaaagugauaggaauagaccuuggaacaacauacuguucaguaggaguauucuuuccaggaacagguaaaguaaaaguaauaccagaugaaaacggacacauaaguauacccucaaugguaaguuuuaccgauaacgauguauacguaggauacgaaucaguugaauuagcagacucaaauccacaaaacacaauauaugacgcaaaaagauuuaucggaaaaaucuucacagcagaggaauuagaagcagaaauaggaagauaucccuucaaaguauuaaauaaaaacggaaugguagaauucucugucacaucaaacgaaacaauaacaguaagcccagaauacguaggcagucgauuacuacuaaaacucaaagaaauggcagaagcguacuuaggaaugccaguagcaaaugccguaauaucagucccagcagaauucgaucuaaaacaacgaaacagcaccauagaagcagccaaucuagcaggauuaaaaauacuaagaguaauaaacgaaccaaccgcagcagccauggcauauggacuacacaaagcagauguauuucacguauuaguaauugaucuaggaggcggaaccuuagacguaucauuauuaaauaaacaaggaggaauguucuuaacuagagccaugucaggaaauaacaaacuaggaggacaagauuuuaaccaacgacucuuacaauacuuauacaaacaaauauaucaaacauauggauuuguuccuagcagaaaagaagaaauacauagacuaagacaagccguagaaaugguuaaauuaaaucuuacacuccaccaaagugcacaacuaagcguguuacuaacaguagaagaacaagacagaaaagaaccacacucuucagacacagaauuaccaaaggauaaauuaucaucagcagaugaccaccgaguaaauucaggauucggaagaggacuaucagauaaaaaaucaggagaaucacaaguucuauucgaaacagaaauaucaagaaaacuauuugacacauuaaacgaagauuuauuccaaaaaauacuaguaccaauacaacaaguacuuaaagaaggacaucuugaaaaaacggaaauagacgaaguaguacucguaggagguucaacaagaauaccaagaauaagacaaguaauucaagaauuuuuuggaaaagacccaaauacauccguagauccagaucuagccguaguaaccggcguagcuauacaagcaggaauagaugguggaucauggccauuacaaguaucagcacucgaaaucccaaacaagcacuuacaaaaaacaaauuucaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3671 - RNA, 1912 nt, Artificial Sequence
  mRNA product Design2 comprising derived and/or modified sequence from Homo sapiens__NP_057383.2__HsHSPA14 (opt12)
ggggcgcugccuacggagguggcagccaucuccuucucggcaucaagcuuaccauggcagcaaucggaguucaucuaggauguacaagcgcaugcguagcaguauacaaagacggucgagcagguguugucgcaaacgaugcaggagauagaguaacaccagcuguaguagcauauagugaaaacgaagaaauaguaggauuagcagcaaaacaaagcaggauucgaaauauaucaaauacaguaaugaaaguaaaacaaauauuaggccgaagcagcuccgacccucaagcacaaaaauauauagcagaaaguaaauguuuaguaauagaaaaaaauggaaaacuaagauacgaaauugauacgggagaagaaacaaaauucguaaauccggaagauguagcaaggcuaauauuuagcaaaaugaaagaaacagcucauaguguauuaggaagcgacgcaaacgacguaguuauaacagucccuuucgauuuuggagaaaaacaaaaaaaugcucuuggagaagccgcaagagcagccggcuuuaauguacuaagacuaauacaugaaccaucagcagcucuauuagcauauggaaucggacaagauucaccaacagguaaaaguaacauacuaguauuuaaauuaggaggaacaucauuaucacuauccguaauggaaguaaauucaggaaucuauagaguauuaaguacaaacacagacgacaacauuggaggagcacacuuuacagaaacuuuagcacaauaucuugcauccgaauuucaaagaaguuuuaaacaugacguaagagguaacgcaagagcgaugaugaaacugacaaauucagcagaaguagcaaaacauagucuaucaacauuaggauccgcaaacugcuuucuagauaguuuauaugaaggacaagacuuugacugcaauguaucaagagcacguuucgaacucuuauguucaccguuauuuaauaaaugcauagaagcaauaagaggacuauuagaucaaaauggauuuacagcugaugauauaaauaaaguuguguuauguggaggaucaucaagaauaccaaaauuacaacaauuaauaaaagauuuauuucccgcaguagaauuauuaaauucaauaccaccagacgaaguaauuccaauaggcgcagccaucgaagcaggcauacuaauaggaaaagaaaaccuauuaguagaagacucauuaaugauagaauguucagcaagagauauauuaguaaaaggaguagaugaaaguggugcgucaagguuuacaguauuauuuccaagcggaacaccacuaccugcaagaagacaacauacgcuacaagcaccagguaguauaaguucaguaugucuagaacuauaugaauccgacggaaaaaacagcgcaaaagaagaaacaaaauuugcacaaguuguuuuacaagauuuagauaaaaaagaaaacggcuuaagagacauuuuagcaguauuaacaaugaaacgcgauggaucacuacauguaacauguacagaccaagaaacaggaaaaugcgaagcaauaaguauagaaauagcuucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3672 - RNA, 2959 nt, Artificial Sequence
  mRNA product Design2 comprising derived and/or modified sequence from Homo sapiens__NP_006635.2 __HsHSPH1 (opt12)
ggggcgcugccuacggagguggcagccaucuccuucucggcaucaagcuuaccaugucaguaguaggacuugauguaggaucacaaucauguuacauagcaguagcuagagccggugggauagaaacaauagcaaacgaauuuagugauagaugcacaccaagugucauaucauuugguagcaaaaacagaacaauaggaguagcagcgaaaaaccaacaaauaacccacgcaaacaacacaguaucaaacuucaaaagauuccacggcagagcauuuaacgaccccuucauacaaaaagaaaaggaaaacuugaguuaugacuuaguaccacucaaaaauggaggaguuggaauaaaaguaauguacaugggggaagaacacuuauuuagcguagaacaaauuacugcaaugcuauuaacaaaacuuaaagaaacagcagaaaacucauuaaagaaaccaguaacagauuguguaaucuccguaccaucuuucuuuacagaugcagaaagacgauccgucuuagacgcagcacaaauaguuggccuaaauuguuuaagguugaugaacgacaugacugccguagcccuaaauuaugguauuuacaaacaagacuuaccaagccucgaugagaaaccccggauaguaguauuuguagacaugggacacagcgcauuucaagugagugccugugccuuuaacaaaggaaaacucaaaguucucgguaccgccuuugauccguuuuuaggaggcaaaaauuucgacgaaaaauuagucgaacauuuuugcgcagaauuuaaaacaaaauauaaauuagacgcgaaaagcaaaauaagagcgcuacugagauuauaccaagaaugugaaaaacuaaagaaacuaaugaguucaaauaguacagaccuaccacuaaauauagaguguuucaugaacgacaaagacguaagcggaaaaaugaauagaucacaguucgaagaacuuugugcagaacuauuacagaaaauagaaguucccuuauauucauuauuagaacaaacacacuuaaaaguagaggaugucucagcuguagaaaucgucggaggagccacccguauuccagcggucaaagaaagaauagcaaaauucuuuggcaaagacauaaguacaacccuaaacgccgaugaagcagucgcaagaggaugugcacuccaaugugcaauccuuaguccagccuuuaaaguaagagaguuuuccguaacugacgcaguaccauuuccuauuucucuaauuuggaaucaugauucagaagauacagaaggaguacaugaaguauuuucaagaaaccaugcagcaccguucaguaaaguauugacauuuuugcgaagaggcccauucgaacuagaagcauuuuacucagauccacaagggguaccauaccccgaagcaaaaaucggaagauuuguuguacaaaacgucucagcacaaaaagauggagagaaaagcagaguaaaaguaaaaguacgaguaaacacucauggaauauucacaauaucuaccgcaagcaugguagaaaaagucccaacagaagaaaacgaaaugucaagcgaagccgauauggaaugcuugaaucaacgaccgcccgaaaacccagauacugacaaaaacguacaacaagauaauucagaagcuggaacucaaccacagguacaaaccgaugcacaacaaaccucacaaagcccaccaagucccgaacuuacguccgaagaaaacaaaauaccagacgcagauaaagcaaacgagaagaaagucgaccaaccaccagaagcaaagaaaccgaaaauaaaaguagugaauguagaauuaccaauagaagccaaccuaguguggcaacuaggaaaagaccuccuaaacauguacauugaaacagaaggaaaaaugauaaugcaagauaaauuggagaaagaaagaaacgacgccaaaaaugcaguagaagaauacgucuacgaguucagagauaaacuaugugguccauaugaaaaauucauaugugaacaagaucaccaaaauuuccuuagauuacuuacagaaacugaagauugguuauaugaagaaggcgaagaucaagcaaaacaagccuacgucgacaaauuagaagaauuaaugaaaauaggaacaccagugaaaguaagauuccaagaagcagaagaaagaccaaaaauguuugaagaauuaggucagcgcuuacaacauuacgccaaaauugcagcagauuuuagaaauaaagaugaaaaauauaaccauauugacgaaucagagaugaagaaaguagaaaaaucagucaaugaaguaauggaauggaugaauaauguaaugaacgcucaagcaaagaaaucauuagaccaagacccaguagugagagcccaagaaauaaaaacaaaaauaaaagaauuaaauaauacaugugaaccuguuguuacacaaccaaaaccaaaaauagaaaguccaaaacuagaacgaacgccaaacggaccaaauauagacaagaaagaagaagaucuagaagacaaaaauaacuucggugcagaaccuccacaucaaaacggagaauguuacccaaacgagaaaaacaguguaaacauggacuuagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3673 - RNA, 3382 nt, Artificial Sequence
  mRNA product Design2 comprising derived and/or modified sequence from Homo sapiens__NP_006380.1 __HsHYOU1 (opt12)
ggggcgcugccuacggagguggcagccaucuccuucucggcaucaagcuuaccauggccgauaaaguaaggcgccaacguccaagaagaagaguauguugggcacuuguugcaguucuacuugcagacuuauuagcacuaagugauacacuugcagugaugaguguagaucuuggauccgaaagcaugaaaguagcaaucguaaaacccggaguaccaauggaaauuguacucaacaaagaaagucgaagaaaaacaccaguaaucguaacucuaaaagaaaaugaaagauuuuucggggauucugcagcaucuauggcaauuaaaaacccaaaagcuacauuacguuacuuccaacauuuacuugguaagcaagcagauaacccucacguugcucuauaucaggcucguuucccagaacaugaacucacauucgacccacaacgacagacaguacacuuucaaauaucaagccaauuacaauucucaccagaagaaguacuagguaugguacuaaacuauucgcgaaguuuagcagaagacuucgcugaacaaccaauaaaagaugccguaauaacagucccagucuucuuuaaccaagcagaaaggagagccguucuacaagcggcuagaauggcaggauuaaaaguauugcaacuaauaaaugacaauacugcgaccgcccuaaguuacggcguuuuucgaagaaaagauauaaauacaacagcccaaaacauaauguucuacgacaugggaaguggaucaacaguaugcacuauaguuacauaccaaaugguaaaaacgaaggaagcaggaaugcaaccacagcuacaaauaagaggaguaggauuugaucguacacuaggaggauuagaaauggaacuaagacuuagagaacgcuuagcaggauuguucaaugaacaaagaaagggccaacgcgccaaggaugugagagagaauccaagagcaauggcaaaauuacucagagaggccaaccgguuaaaaacaguguuaucagcaaacgcagaucauauggcucagauagaaggacugauggaugacguugauuucaaagcaaaagucacacgaguugaauuugaagaguuaugugcagauuuauucgaaagaguuccuggaccuguucaacaagcgcuacaaagugcagaaaugaguuuagaugagauugaacaagugauucuaguuggcggagcaacucgaguuccaagaguccaagaaguacuguuaaaagccguaggcaaagaagaauuagguaaaaauauaaaugccgaugaagcagccgcaaugggagccguuuaucaagcugcugccuuaucgaaagcauuuaaaguaaaaccauuuguuguaagggacgccgugguauacccaauauuagucgaguuuacacgagaagucgaagaagaacccggaauacauucauuaaaacauaacaaacgaguucuauuuucaagaauggggccguauccacaaagaaaaguaauaaccuuuaauagauacucccacgauuuuaauuuccacauuaauuauggagaucuaggauuuuuagguccggaagaucuucguguauuugggucacaaaauuugacaacagucaaacuaaaaggagucggagacucauuuaagaaauauccagauuaugaaucaaaaggaauuaaagcucauuucaauuuggaugaaaguggaguacucagucuagauaggguagaaagcguauuugaaacauuagucgaagacucagcagaagaagaaagcacucugacuaaacuaggaaauacaauaucaucacuauucggaggugggacgaccccagaugcaaaagaaaauggaacagauacuguacaggaagaagaagaaucaccagcagaaggaagcaaggaugaaccaggugagcaaguagaacuaaaagaagaagcagaagcaccaguagaagacggaagucaaccaccuccaccagaaccuaaaggagacgcgaccccagaaggagaaaaagcuacagaaaaggaaaauggagauaaaucagaagcucaaaaaccgucagaaaaagcugaagcaggaccagaaggcguugccccagcaccggagggagaaaagaaacaaaaaccagcaagaaaaagaagaaugguggaagaaaucgguguagagcuaguaguauuagacuuaccugacuuaccagaagauaaauuggcucaauccguucaaaaacuucaagaucuaacacuuagagacuuagaaaaacaagaacgagaaaaagcagcaaacucacuagaagcauuuauauucgaaacacaggauaaacuauaccaaccagaauaccaagagguuucaacugaggaacaaagggaagagaucucaggaaaacucagugcagccaguacaugguuggaagacgaaggaguaggcgcaacaacggucauguuaaaagaaaaacuagcggaacuuagaaaauuaugccaaggauuauuuuucagaguugaagaaagaaagaaauggccagaaagauuauccgcuuuggauaauuuauuaaaucauucaucaauguuucuaaaaggcgcaagauuaauaccugaaauggaucaaauauucacagaaguagaaaugacuacauuagaaaaaguaauaaaugaaacuugggcuuggaaaaaugcuacacuagcagaacaagcaaaauuaccagcuaccgaaaaaccaguacuacuaucaaaagacauagaggcaaaaaugauggcccuagacagagaaguucaauaucuacuaaauaaagcaaaauuuacuaaaccuagaccaagaccuaaagauaaaaaugguacacgagcugagccuccacucaaugcguccgcauccgaucaaggagaaaaaguuauacccccugccggacaaacagaagacgcagagccaaucucagaaccagaaaaaguggaaacaggaagugaaccuggagacacagaaccacuagaacucggagguccgggggcagaaccagaacaaaaagaacagaguacaggacaaaaacgaccgcuaaagaaugaugaguuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3674 - RNA, 2581 nt, Artificial Sequence
  mRNA product Design2 comprising derived and/or modified sequence from Homo sapiens__NP_005339.3 __HsHSP90AA1 (opt12)
ggggcgcugccuacggagguggcagccaucuccuucucggcaucaagcuuaccaugccagaggaaacccaaacucaagaucaaccaauggaagaagaagaaguagaaacauuugcuuuccaagccgaaauagcacaacugaugucacuaauaauaaauacauuuuauucaaacaaggaaauuuucuugagagaacucauaaguaacucaagcgacgcacucgacaaaauaagauacgaaagccuaacagacccgucuaaacuggacucaggaaaagagcuacauauaaaccuaauaccuaacaaacaagauagaacacuaaccauaguagauacaggaauagguaugacaaaagcagauuuaauaaacaaccuaggcacaauagccaaguccggaaccaaagcguucauggaagcgcuccaagccggcgcagauaucagcaugauaggacaauucgggguaggauucuacucagcauaucuaguagcagaaaaaguaacgguuaucaccaaacauaaugacgacgaacaguacgcaugggaaaguucggcaggcggcucauucacagucagaaccgacaccggggaaccaaugggaagagguacaaagguaauacuacaccuuaaagaagaccaaacagaauaccuagaagaaaggagaauaaaagaaauaguaaaaaaacacucacaauucauuggauacccaauaacauuauuuguagaaaaagaaagagacaaagaaguaagcgacgaugaagcagaagaaaaagaagauaaagaagaagagaaagaaaaagaagagaaagaaagugaagacaaaccagaaauagaagacguuggcucggaugaagaagaagaaaaaaaagacggagauaaaaaaaaaaaaaaaaaaauaaaagaaaaguacauagaucaagaagaacucaauaaaacaaagccaauauggacacgaaauccagaugacauaacuaacgaagaauacggcgaauuuuauaaaaguuuaacaaacgacugggaagaccaucucgcaguaaaacauuuuucaguagaaggacaacuagaauucagagcacuauuauucguccccagaagagcaccauuugauuuauuugaaaauagaaaaaaaaaaaacaacauuaaacuauauguaagaagaguuuucauaauggacaauugugaagaauuaauaccagaauaucuaaacuuuauaagaggggugguugacagcgaagauuuaccgcuuaacauaagccgagaaauguugcaacagaguaaaauacuaaaaguaauaagaaaaaaucuaguaaaaaaauguuuagaauuauuuacggaauuagcagaggacaaagaaaacuacaagaaauuuuacgaacaauucaguaaaaacauaaaauuaggcauacacgaagacagucaaaauagaaagaaacuaucagaacuacuaagauauuacacaagugcaaguggagaugaaaugguaagcuuaaaagacuacuguacaagaaugaaggaaaaccaaaaacauauauauuauauaacaggagaaacaaaagaucaaguagcaaacagugccuucguagaaagacuaagaaaacaugggcuagaaguaauauacaugauagaaccuauagaugaauauugcguacaacaacuaaaagaauuugaaggaaaaacccuaguaucgguaacaaaggaaggauuagaauuacccgaagaugaagaagaaaaaaagaaacaagaagaaaaaaaaacaaaauucgaaaaccuaugcaaaauaaugaaagauauacuagaaaaaaaaguugaaaaaguugugguaucuaacagauuaguaacuucaccaugcugcaucguaacuaguacguauggcuggacagcaaacauggaaagaauaaugaaagcacaggcuuugagagauaacaguaccaugggauauauggcagcaaaaaaacaucuagaaauuaauccagaccacaguauaauagaaacguuaagacagaaagcagaagcggacaagaacgacaaaucaguaaaagaccucguuauacuacucuaugaaacagcacuacuaagcaguggauuuucauuagaagauccacagacacacgcaaacaggauuuauagaaugauuaaacuuggacucggaauagacgaagaugacccaacagcagaugacacaagugcagcagugaccgaagaaaugccaccguuagaaggggaugacgacacuaguagaauggaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3675 - RNA, 721 nt, Artificial Sequence
  mRNA product Design2 comprising derived and/or modified sequence from Homo sapiens__NG_005218__HsHSP90AA3P (opt12)
ggggcgcugccuacggagguggcagccaucuccuucucggcaucaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauuuauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3676 - RNA, 2557 nt, Artificial Sequence
  mRNA product Design2 comprising derived and/or modified sequence from Homo sapiens__NP_031381.2__HsHSP90AB1 (opt12)
ggggcgcugccuacggagguggcagccaucuccuucucggcaucaagcuuaccaugccagaagaaguacaccauggagaagaagagguagaaacauucgcauuucaagcagagauugcacaacuaaugaguuugauaauaaauacauuuuauagcaacaaagaaauauuuuuaagagaacuaauuucuaacgcaagcgacgcauuagacaaaauacgauaugagagucuaacugauccaaguaaacuagauaguggaaaggaacuuaaaauagacauaauaccgaauccacaagaacgaacauugacacuaguggacacaggcauaggaaugacaaaggccgaucuaauaaauaaucuuggcacaauagcaaaaagugggacuaaagcguuuauggaggcacuacaagcgggagcagauauaaguaugauaggacaauuuggaguuggauuuuauucagcauacuuaguggcagaaaaaguugucguaauaacaaaacauaacgaugacgaacaauacgccugggaaucaagcgcaggaggaaguuuuacaguaagagcagaccacggugaaccaaucggaaggggaacaaaaguaauacuacacuuaaaagaagaucaaacagaguauuuggaagaacgaaggguaaaagaaguaguaaaaaaacacucacaauuuauaggauauccgauaacauuguaccuagaaaaggaaagggaaaaagaaauaagcgaugacgaagcagaagaagaaaaaggggaaaaggaagaagaagauaaagacgaugaagaaaaaccaaaaauagaggacguaggaagugaugaagaagaugacucaggaaaagauaaaaaaaaaaaaacuaaaaaaaucaaagaaaaauacauagaucaagaagaauuaaauaaaacaaagccaauauggaccagaaacccagacgacauaacacaagaagaauauggcgaauucuauaaaagucuaacaaaugacugggaagaccaccuagcaguaaaacacuucagcgucgaaggucaauuagaauucagagcucuacuauuuauaccaagaagagcaccauucgaucuauucgaaaacaaaaaaaaaaaaaauaauauaaaacucuacguccgcagagucuuuauaauggacucgugcgacgaacuaaucccagaauauuuaaacuuuaucagagggguaguagacucagaggaccucccacuaaacauaagcagggaaaugcuucaacaaagcaaaauccuaaagguaaucagaaaaaauaucgucaaaaaaugccucgaacuauuuucagaauuagccgaagauaaagaaaacuacaaaaaauuuuacgaagcauucagcaaaaauuuaaaacuaggcauacacgaagacuccacaaacagaagaagauuaagcgaauuacuaagauaucacacaucacagucgggagaugaaaugacaucuuuaucagaguacguaagccgaaugaaagaaacacaaaaaaguauauacuauaucacuggagaaaguaaagaacaaguagcgaacucagcauuuguagaacguguaagaaaacgaggauuugaaguaguauacaugacagaaccaauugacgaauacuguguccaacaauuaaaagaauucgaugguaaaaguuuaguuucaguaacaaaagaaggauuagaauuaccugaagacgaagaagaaaagaaaaaaauggaagaaagcaaagcaaaauuugaaaaucuaugcaaacucaugaaagaaauauuagacaaaaaaguggaaaaagucacgauuuccaacagacucguaagcucacccuguugcauaguaacaucuacauaugguuggacugcaaacauggaaagaauaaugaaagcacaagcuuugagagacaauucaacaaugggauauaugauggcaaagaaacauuuagaaauaaacccagaccauccaaucguagaaacacugagacaaaaggcagaagcagacaaaaaugauaaggccgugaaagaucuugugguacuucuauucgaaacagcccuacugaguaguggauucaguuuagaagacccacaaacacacuccaauagaaucuaucgaaugaucaaacuaggauuaggaauagacgaggaugaaguagcugcagaagaaccaaaugcagcaguaccagaugaaauaccaccgcuagaaggagaugaagaugcgagccgcauggaagaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3677 - RNA, 2794 nt, Artificial Sequence
  mRNA product Design2 comprising derived and/or modified sequence from Homo sapiens__NP_003290.1__HsHSP90B1 (opt12)
ggggcgcugccuacggagguggcagccaucuccuucucggcaucaagcuuaccaugagagcacuguggguauuaggauuaugcugcguauuacuaacguuuggaucagugagagcagaugaugaagucgauguugauggaacaguagaggaagaccucgguaaaaguagagaaggcucaagaacugacgacgaaguuguucaaagagaagaagaagcgauacaauuagauggauuaaaugcaucacaaauaagagaacuucgugaaaaaucagaaaaauuugcguuucaagcagaaguaaacagaaugaugaaacuaauaauaaauucauuauacaaaaauaaagaaauauuuuuaagagaacuuauuucaaacgcaagcgaugcauuggauaaaauaagauugauaagucuaacagaugaaaacgccuuaucaggaaaugaagaauuaacaguaaaaauaaaaugcgauaaagagaaaaauuuacuacauguaacugacacgggaguaggaaugacaagagaagaauuagucaaaaauuugggaacaauagccaaaucaggaaccucagaauuucuaaacaaaaugacugaagcacaagaagacgggcaaucaacaagugaauuaauaggacaauuugggguaggauucuacagugcguuuuuaguagcggacaagguaauaguaaccaguaaacauaauaacgacacacaacauauaugggagucagacaguaacgaguucaguguaaucgcagacccgagagguaacacauugggacgaggaacaacuauaacguuaguacucaaagaagaggcuucagauuaccuagaacuggauacaauaaagaaucucgugaagaaauauucccaauucaucaacuucccaauauacguauggaguucaaaaacagaaacaguggaggaaccaauggaagaagaagaagcagcuaaagaagagaaagaagaaucagaugaugaagcugcagucgaagaagaagaagaagaaaagaaaccgaaaacuaagaaaguagagaaaacaguuugggauugggaacuaaugaacgacauaaaaccaauuuggcaacgaccgucaaaagaaguggaagaggaugaauauaaagcauuuuacaaaucauucucuaaagaaucagaugauccaauggcauauauacauuuuacagcagaaggggaaguaacauuuaagucaauccuauuuguaccaaccucagcaccgaggggauuauucgacgaauauggaagcaagaaaucggauuauauaaaacuauauguaagaaggguauuuauaaccgaugauuuccacgauaugaugcccaaauaucuaaauuuuguaaaaggaguaguagacagcgacgaucuaccauuaaauguaucucgagaaacacuccaacagcauaaacuccuaaaaguuauaaggaagaaauuagucaggaaaacacucgauaugauaaagaaaauagcagaugauaaauauaacgacacauuuuggaaagaauuugguacaaauauuaaauuaggaguaaucgaagaucacaguaacagaacgagauuagcaaaacuauugagauuucaaaguucacaccacccaacagauauaacuagcuuagaccaauauguggaaaggaugaaagaaaaacaagauaaaauuuauuuuauggcagggaguaguaggaaagaagcugaaaguagccccuucguggaaagauuauuaaagaaaggauaugaaguaauauaucuaacagaaccaguagacgaauauuguauacaagcacuaccagaguucgacggaaaaagauuucaaaauguagccaaagaaggaguaaaauuugacgagucagagaaaacaaaagaaagcagagaagcaguagaaaaagaauuugaaccucuacuuaacuggaugaaagauaaggcuuuaaaagauaaaauagaaaaagcaguaguaagccaaagacuuacagaaucaccaugugcauugguagcaagucaauauggauggaguggaaacauggaaaggauaaugaaagcacaagcguaccaaacaggaaaagauauaucaacgaauuacuaugccagccagaaaaagacauucgaaauaaauccaagacacccauuaauaagagacauguuaagaagaauuaaagaagaugaagaugauaaaacuguauuagaccuugcaguaguuuuguucgaaacggcaacauuacgaaguggcuaucugcuaccggauacaaaagcauauggagacagaauagaacgaauguuaagacuaucauuaaauauagauccugaugccaaaguagaagaagaaccagaagaagaaccagaagaaacggcagaagauacaacagaagacaccgaacaagacgaggaugaggaaauggacguaggaacugaugaagaagaagaaacagcaaaagaaagcacugcagaaaaagaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3678 - RNA, 2497 nt, Artificial Sequence
  mRNA product Design2 comprising derived and/or modified sequence from Homo sapiens__NP_057376.2__HsTRAP1 (opt12)
ggggcgcugccuacggagguggcagccaucuccuucucggcaucaagcuuaccauggcaagagaacuaagagcauuacuauuauggggccgccgacuaagaccucucuuaagagcuccagcacuagcagccguaccaggcggaaagcccauacuauguccaaggagaacaacugcacaacuaggaccaagaagaaauccugcuuggagucugcaagcagguaggcuuuucuccacacaaacagcugaagacaaagaagaacccuuacauucaauaauaucuaguacagaaucuguucaaggaaguaccucaaaacaugaauuucaagcagaaacaaaaaaacuacuagacauaguagcacgaucacuauauagugaaaaagaaguuuuuauaagagaauuaauaaguaacgccucagaugcacuagaaaaauuacgacacaaauuaguaagcgauggucaagcuuuaccagaaauggaaauacauuuacaaacuaacgcugaaaaaggaaccauuacaauacaagauacagguauaggaaugacacaagaagaacuuguuaguaaucuaggaacaauagcucgaucaggaucaaaagcauucuuagacgcauuacaaaaccaagcagaagcuagcucgaaaauaauuggucaauuuggaguaggauuuuauucagcauucaugguugcagacaggguagaaguauauucacguagcgcugcaccaggaucauuagguuaccaauggcuaucagacgguucaggcguuuucgaaaucgcagaagcaucaggaguaagaacaggaacaaaaauaauaauacaccuaaaaagugauuguaaagaguucucuagugaagcaagaguuagagauguaguaacaaaauauucuaauuuuguaucguuuccacuauacuuaaauggacgaagaaugaauacacuacaagcaauauggaugauggauccaaaagauguacgagaauggcaacaugaagaauucuacagauacguugcacaagcacaugacaaaccaagauauaccuuacauuauaaaaccgacgcaccuuuaaauauaagaucaaucuuuuauguuccagacaugaaacccucuauguucgacguaucaagagaacuaggaaguaguguggcccuuuauucaagaaaaguccuaauucaaacaaaagcaacagauauauuaccuaaaugguugagauuuaucagaggaguaguagauucagaagacaucccauuaaaucuaaguagggagcuauuacaagaaucagcauuaauaaggaaacuaagagacguuuuacaacaaagacuuauaaaauuuuuuauagaucaaagcaaaaaagaugcagaaaaauacgcuaaauuuuucgaagacuaugggcuauuuaugagagagggaauaguaacagcaacugaacaagaaguaaaagaagacauugcaaaacuacucagauaugaaaguagugcucugccuagcggucaauuaacaagucugucugaauaugcuucacgaaugagggccggaacaagaaauauauacuacuuaugcgcaccaaaccgacacuuagcagaacauucacccuauuaugaggcaaugaaaaagaaagacacagaaguucuauuuugcuuugaacaauucgacgaacucacuuuacuacaccuaagagaauuugacaaaaaaaaauuaauuagcgucgaaacagauauagugguugaccauuauaaagaagaaaaauuugaggauagaucuccagcggccgaaugccuuucagaaaaagaaacagaagaacuuauggccuggaugagaaacguucuagggucuagaguaacaaaugugaaaguaacauuaagauuagacacacauccggcaaugguaacaguucuagaaaugggagcggcaagacacuuuuuaagaaugcaacaauuggcaaaaacacaggaagaaagagcacaauuauuacagccaacacucgaaaucaacccuagacacgcauuaauaaaaaaacuaaaucaacuaagagcaucagaaccaggacuugcacaauugcuagucgaucaaauauacgaaaaugcaaugauagcagcaggauuaguagaugauccacgagcgaugguaggacgacuaaaugaguuauuaguaaaagcauuagaaagacacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3679 - RNA, 844 nt, Artificial Sequence
  mRNA product Design2 comprising derived and/or modified sequence from Homo sapiens__NP_000609.1__HsIGF1 (opt12)
ggggcgcugccuacggagguggcagccaucuccuucucggcaucaagcuuaccaugggaaaaauaucaucacuaccaacacaacuauucaaaugcugcuucugcgacuuccuaaaaguaaaaaugcacacaaugucaucaucacaccuauucuaccuagcacuaugcuuauuaacauucacaucaucagcaacagcaggaccagaaacacuaugcggagcagaacuaguagacgcacuacaauucguaugcggagacagaggauucuacuucaacaaaccaacaggauacggaucaucaucaagaagagcaccacaaacaggaauaguagacgaaugcugcuucagaucaugcgaccuaagaagauuagaaauguacugcgcaccacuaaaaccagcaaaaucagcaagaucaguaagagcacaaagacacacagacaugccaaaaacacaaaaagaaguacaccuaaaaaacgcaucacgaggaucagcaggaaacaaaaacuacagaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3680 - RNA, 925 nt, Artificial Sequence
  mRNA product Design2 comprising derived and/or modified sequence from Homo sapiens__NP_000603.1__HsIGF2 (opt12)
ggggcgcugccuacggagguggcagccaucuccuucucggcaucaagcuuaccaugggaauaccaaugggaaaaucaaugcuaguacuacuaacauuucuagcauucgcaucaugcuguauagcagcauacagaccaucagaaacacuaugcggaggagaauuaguagauaccuuacaauuuguauguggagacagaggauucuauuucucaagaccagcaucaagaguaucaagaagaucaagaggaauaguagaagaaugcuguuucagaucaugugacuuagcauuacuagaaacauauugcgcaacaccagcaaaaucagaacgagauguaucaacaccaccaacaguacuaccagauaacuuuccaagauacccaguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccacuaauugcauuaccaacacaagauccagcacacggaggagcaccaccagaaauggcaucaaacagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3681 - RNA, 1021 nt, Artificial Sequence
  mRNA product Design2 comprising derived and/or modified sequence from Homo sapiens__NP_000591.1__HsIL6 (opt12)
ggggcgcugccuacggagguggcagccaucuccuucucggcaucaagcuuaccaugaacucauucucaacaucagcauucggaccaguagcauucucacuaggacuacuacuaguacuaccagccgcauucccagcaccaguaccaccaggagaagacucaaaagacguugcagcaccacacagacaaccccuaacauccucagaaagaauagacaaacaaauaagauacauacuagacggaauaucagcacuaagaaaagaaacaugcaacaaaucaaacaugugcgaaucaucaaaagaagcacuagccgaaaacaaccuaaaccuaccaaaaauggcagaaaaagacggaugcuuccaaucagguuucaacgaagaaacaugccuaguaaaaauaauaacaggacuccuagaauucgaaguauaccuagaauaccuacaaaacagauucgaaucaucagaagaacaagcaagagcaguacaaaugucaacuaaaguacuaauacaauuccuacaaaaaaaagcaaaaaaccuagacgcaauaacaacaccagacccaacaaccaacgcaucacuacucacaaaacuacaagcacaaaaccaauggcuacaagacaugacaacacaccuuauacuacgaucauucaaagaauuccuccaaucaucccuccgagcccucagacaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3682 - RNA, 1663 nt, Artificial Sequence
  mRNA product Design2 comprising derived and/or modified sequence from Homo sapiens__NP_002183.1__HsINHBA (opt12)
ggggcgcugccuacggagguggcagccaucuccuucucggcaucaagcuuaccaugccauuacuaugguuaagaggauuuuuauuagcuaguugcuggauaauagucagaucaagcccaacgccaggaagcgaaggacacucagcagcuccagacuguccaaguugugcauuagcagcauuaccuaaagauguuccuaauucacaaccagaaaugguagaagcaguaaaaaaacauauauuaaauauguuacacuuaaaaaaaaggccagacguaacacaaccaguuccaaaagcagcauuauugaacgcaauaagaaaauuacacguaggaaagguaggggaaaacggauauguagaaauagaagacgauauaggaagaagagcagaaaugaaugaacuaauggaacaaacaagugaaauaauaacuuucgcagaaagcggaacagcaagaaaaacacuacacuuugaaauaaguaaagaagggagcgauuuaucaguaguagaaagagcagaaguaugguuauuucuaaaaguaccaaaagcaaauagaacuagaacaaaaguaacaauaagacuauuccaacaacaaaaacauccacaaggaucuuuagauacuggagaagaagcggaagaaguaggacuuaaaggagaaagaucagaacuacuauuaagugaaaaaguaguagaugcacgaaaaaguacauggcauguauuuccaguauccaguucaauacaaagacuauuagaucaaggaaaaagcagcuuagacguuagaauagcuugugaacagugucaagaaucaggagcaaguuuaguuuuacuaggaaaaaaaaaaaaaaaagaagaagagggagaagguaaaaaaaaaggugggggagaaggaggagcaggagcugaugaagaaaaagaacaaucacauagacccuucuuaaugcuacaagcaagacaaucagaagaucauccacauagaagaagacgaagaggcuuagaaugugauggaaaaguaaauauauguugcaaaaaacaauucuuuguaucauuuaaagauauaggauggaaugauuggauaauugcacccagcgguuaucaugcaaacuauugugaaggagaaugcccaucacacauagcgggaacuaguggaaguucauuaagcuuucacucaacugugauaaaucauuaucguaugagaggccauucgccguuugcaaauuuaaaaucauguuguguaccaacaaaacuaagaccaaugaguauguuauauuaugacgauggacaaaauauaauaaagaaagacauacaaaauaugauaguagaagaauguggauguaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3683 - RNA, 1606 nt, Artificial Sequence
  mRNA product Design2 comprising derived and/or modified sequence from Homo sapiens__NP_002184.2__HsINHBB (opt12)
ggggcgcugccuacggagguggcagccaucuccuucucggcaucaagcuuaccauggacggauuaccuggcagagcuuugggagcagcaugucuauuacuauuagcugcaggaugguuaggaccagaagcauggggaucgccaacaccaccaccaacaccagcugcaccaccaccaccaccaccuccugguucaccaggcgggucucaagacaccuguacaagcuguggaggcuuuaggaggccagaagaacuaggaagaguagauggagacuuuuuagaagcuguaaaaagacauauacuuaguagacuccaaaugagaggaagaccaaauauaacacaugccguaccaaaagcugcaaugguaacugcacuucgaaaacuacaugcaggaaaaguaagagaagauggaaggguagaaauaccucaucuagauggacaugcaucaccaggagcagauggacaagaaagaguaucagaaauaauaucuuuugcagaaacagauggauuagcgucaucaagaguaagauuauacuuuuucauaucaaacgaaggaaaucaaaauuuauuuguaguacaagcgagcuuaugguuauaucuaaaauuauuacccuauguuuuagaaaaaggaucaagacgaaaaguaagaguaaaaguuuauuuucaggaacaaggacacggagacagauggaauaugguagaaaagagaguagacuuaaaaagaaguggauggcauacauucccacuaacugaagcaauucaagcacuauuugaaagaggagaaagaagauuaaaccuagaugugcaaugugauucuugucaagaauuagcagucguaccaguauuuguugauccaggagaagaaagucauagaccauuugugguaguucaagcaagauuaggagauaguagacauaggauaagaaaaagaggauuagaaugugauggaaggacaaauuuauguuguagacaacaauucuuuauugacuuuagauuaauaggauggaaugauuggauaauagcacccacaggauauuaugggaauuauugugaaggaaguuguccagcauacuuagcaggaguacccggaucagcaaguuccuuucauacagcaguugucaaccaauaucgaaugagaggguuaaauccagguacaguaaacucauguuguauaccaaccaaacuaaguacuaugagcauguuauauuuugaugaugaauauaacauuguaaaacgagauguaccaaacaugauaguagaagaauguggaugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3684 - RNA, 3841 nt, Artificial Sequence
  mRNA product Design2 comprising derived and/or modified sequence from Homo sapiens__NP_000623.2__HsITGAM (opt12)
ggggcgcugccuacggagguggcagccaucuccuucucggcaucaagcuuaccauggcauuaagaguauuacugcugacagcuuugacucuaugucacggcuucaaccuagacacagaaaaugcuaugaccuuucaagaaaaugcacgagguuucggacagucugucguccaacuacaaggaucaaggguuguagucggcgcaccccaagaaauuguagcagcaaaucaaagaggcuccuuauaucaaugcgacuacucaacagguagcugcgaaccaauacgucuucaaguucccguugaagcagugaacaugucacuugguuuaaguuuagcagcuacaacaagcccaccucaacuauuagcuugcggccccacaguacaccaaaccuguagcgaaaauacuuauguuaaaggauuguguuuccuauucgguuccaauuuacgacagcaaccucaaaaauucccugaagcacuucguggaugcccccaagaagauagcgauauagcauuuuuaaucgacgguuccggauccauaauaccccaugacuuccggagaaugaaagaauuuguaaguacagugauggaacaauugaagaaaucuaaaacucuauuuucucugaugcaauauagugaagaauuuaggauacacuuuacuuuuaaagaauuucaaaacaacccaaauccgagaucguuaguaaaaccgauuacucagcuuuuaggacgaacucauacagcuacuggaauacguaaaguaguaagagaacucuucaacauaacaaauggcgcacguaaaaaugcuuuuaagauauuaguaguaauuacagacggagaaaaauucggagauccucuaggauacgaagacguaauaccagaagcugauagagagggcguaauaagauauguaauaggcguuggagaugcauucagaagcgagaaaagcagacaagaauugaacacaaucgcaucuaaacccccacgagaucauguauuccaggucaauaauuucgaagcucuaaaaacaauacaaaaccaacugagagagaaaauauuugcaauagaagggacacaaacaggcucaucgagcucauuugaacaugaaaugagccaagaaggauuuucagcagcaauaaccucaaacggaccacuauuauccacuguuggaaguuaugauugggcagggggagucuucuuauacacguccaaagaaaaaucuacauuuauaaacaugaccagaguugacagugacaugaaugacgcuuaccucggcuaugcagcagcuauuauacuacgaaauagaguacaaucacuuguuuuaggggcaccacgguaccaacauauuggucuaguugccauguuccgacaaaauacaggaaugugggaaucaaaugccaauguaaaaggaacacaaauaggagcuuauuucggcgcaucauuauguuccguagauguagacucaaacggaucaacagauuuaguccugauuggugccccacauuauuaugaacaaacaagagguggucagguaaguguuuguccgcucccacgagguagagcccgauggcaaugcgaugcuguacuuuauggagaacaaggacagccauggggaagauucggggcagcacuaacaguacuaggugacgugaauggggauaaacuaaccgauguagcaauaggugcaccaggcgaagaagacaauagaggagcaguauacuuauuucacggaacaucaggcucaggaauaagcccuucgcacucacaaagaaucgcuggcaguaaauuaagcccucgccuucaauacuuuggacagucgcuuaguggaggccaagaucuaacaauggacggauuaguugaccuaacgguaggagcacagggucauguccuacuauuacgaucccaaccuguuuugcgugucaaagcaauuauggaguucaauccaagagaaguagcacgaaauguuuuugaaugcaaugaucaaguaguuaaaggcaaagaagcuggagaaguacggguuugucuacauguacaaaaauccacacgagaccgucuacgcgaaggucaaauacaaucaguaguuaccuaugaucuugcacuugacucuggaagaccucacucuagggcuguauuuaaugaaacuaaaaauuccacgagacgacaaacacaaguacuaggucuuacccaaacuugugaaaccuuaaagcuacaacucccaaauugcauagaagauccaguaaguccaauaguacugagacucaauuucucccuugucggaaccccucuaagcgcguucggaaacuuacgaccaguacuagcagaagacgcacagagacuuuuuacugcacuuuuuccauucgagaaaaauugcggaaacgacaauauaugucaagacgacuuaucuauaacauuuucauucaugucauuagauuguuugguaguuggagguccccgggaguucaaugucacaguaacagucagaaaugauggagaagauucuuaccgaacacaaguuaccuuuuucuuuccacuugauuuaagcuaccgaaaagucucuacacuacagaaccaacgaagucaacgcucguggagacuugcaugugaaagcgcuucuucaacugaaguuucaggugcuuugaaaucaacaucauguaguauaaaccaucccauuuuuccggaaaauucugaaguuacauuuaacauuacguucgaugucgauucaaaggcuucucuugguaauaaauuacuauugaaagcaaaugucacauccgaaaauaauaugccaaggaccaacaaaacagaguuccaacuugaauuaccuguaaaauaugcugucuacaugguuguaacaucacauggaguaucuaccaaauaucucaauuuuacagcaucugaaaauacuucacgaguaaugcaacaccaauaccaaguaucaaauuuaggacaacgaucacucccaauuagucuuguuuuucuagucccagucagauugaaucaaacaguaaucugggauagaccacaaguaacauuuucugaaaacuuaagcaguacaugucauacaaaagaacgcuuaccaucccauuccgacuuucuugcugaauuaagaaaagcaccugucgucaauugcucaaucgcagugugccaacgaauacaaugugacauucccuucuuuggcauacaagaagaguuuaacgcuacacuaaagggcaauuuauccuuugacugguacauaaaaacaucacauaaucaucuauuaauuguaucaacagcagaaauauuauuuaacgacagcguauucacacuucuccccgggcaaggagcuuuugucagaagucaaacagaaacaaaaguagaaccauucgaaguuccaaaccccuuaccucucauaguagguuccucgguagguggauuacuacugcuugcauuaauuacagccgcuuuauauaaacuuggauucuuuaagagacaauauaaggauaugaugucugaaggaggaccuccuggcgcagaaccacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3685 - RNA, 1786 nt, Artificial Sequence
  mRNA product Design2 comprising derived and/or modified sequence from Homo sapiens__NP_002415.1__HsMMP8 (opt12)
ggggcgcugccuacggagguggcagccaucuccuucucggcaucaagcuuaccauguucucacuuaaaacucucccauucuuacuacuacuacacguccaaauaucaaaagccuuccccguauccucaaaagaaaaaaauacuaaaacaguucaagacuaccucgaaaaauucuaccaacuaccuucaaaccaauaccaaucaacaagaaaaaaugguacuaaugucauagucgaaaaauuaaaagaaaugcaaagauuuuuuggacuuaacguuacaggaaaaccuaacgaagaaacccuagacaugaugaaaaaaccacgaugcggagucccagacucaggaggcuucaugcuaacaccaggaaauccaaaaugggaacguacaaacuuaacauaccgcauacgaaacuacaccccacaacuaagugaagcagaaguagaacgcgccauaaaagacgccuucgaacuauggucaguagcaagcccacucauauuuacuagaauaucacaaggugaagcugauaucaauaucgcauuuuaccaacgagaccacggcgauaacucaccauucgacggcccaaauggaauacuagcccacgcauuccaaccaggacaaggaauaggaggugacgcacacuucgacgcagaagaaaccuggacaaacacaucagcaaacuauaacuuauuucuagucgccgcacacgaauucggacacucacuagguuuagcacacucaucagacccaggcgcacuaauguaucccaacuaugcauucagagaaaccucaaauuauucauuaccucaagacgauauagacggaauucaagcaauauauggacuuucuucaaauccaauacaaccaacaggcccuucaaccccaaaacccugugaucccucacuaacauucgacgcaaucacaacucuacgaggagaaauuuuauucuuuaaagacagauauuuuuggagaagacacccacaacuacaaagaguagaaaugaacuucauaagcuuauucuggccaucacuaccaacaggcauucaagcagcauacgaagacuucgauagagaccuaauauucuuauuuaaaggaaaccaauauugggcacuaucagguuacgacauacuacaaggauacccaaaagacauauccaauuauggauucccaucaucaguacaagcaauagacgcagcaguauucuauagaucaaaaaccuacuucuucguaaaugaucaauucuggagauacgacaaccaacgccaauucauggaacccggauaucccaaaucaauaucaggagcauucccaggaauagaaucaaaaguagacgcuguauuccaacaagaacauuucuuucaugucuucuccggacccagguacuacgcauuugauuuaauagcccaaagaguaacacgaguagcaagaggaaauaaaugguugaauuguagauacggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3686 - RNA, 2506 nt, Artificial Sequence
  mRNA product Design2 comprising derived and/or modified sequence from Homo sapiens__NP_004985.2__HsMMP9 (opt12)
ggggcgcugccuacggagguggcagccaucuccuucucggcaucaagcuuaccaugagccuuuggcaacccuuaguuuuaguuuuacuaguauuaggaugcugcuucgcagcuccuagacaaaggcaaucaacacuuguucucuuuccaggagacuuacgaacaaaucuaacagauagacaacuagcagaagaauacuuauauagauauggauauaccagaguugcagaaaugagaggagaaaguaaaucguuaggaccugcccuacuacuucuucaaaaacaauuaucauuaccagaaacaggagaacuagauucugcuacacuaaaagcaaugagaaccccuagaugcggaguuccagauuuaggccgauuucaaacauuugaaggagaccuaaaauggcaccaucauaauauaacuuauuggauacaaaauuacucugaagacuuaccgagagccguaauagacgaugcauucgcuagagcauuugcuuuauggucagcaguuacaccccuaacauuuacuagaguauauucaagagaugcugauauaguaauucaauuuggagucgcagaacauggugauggauauccauuugauggaaaagacggauuauuagcccacgcauucccaccugguccaggcauucaaggagaugcacauuucgacgaugacgaauuauggagcuuaggaaaaggaguaguaguaccuacacgcuuugggaaugcugauggagcagcaugccauuucccauuuauuuucgaagguagaucauacucugcaugcacuacagauggaagauccgauggauuaccuuggugcagcacaacagcuaauuaugacacugaugacagauuugguuuuuguccauccgaaagacuuuacacacaagacggaaaugcagaugguaaaccaugccaauuuccuuuuauauuucagggacaaucauauucagcuuguacaacagaugggagaagugauggauaccgcuggugugcaaccacugccaauuaugauagagacaagcuauuuggauucuguccuacaagagcagacucgacuguaauggguggaaauucagccggagaacuaugugucuucccauuuacauuuuuagguaaagaauacucuacauguacuucagaaggccguggugauggaagacuuuggugugcaacaacaucaaauuucgacucugacaaaaaauggggauuuuguccagaucaaggauacagcuuauuucuaguugcagcacacgaauuuggacaugcacuagguuuagaucacaguucaguaccagaagcauuaauguauccaauguauagauuuaccgaagggccuccccuucacaaagaugacguuaauggaauaagacacuuauacggacccagaccugaaccugaaccaagaccuccuacuacaacuacuccacaaccaacagccccaccaacaguaugcccaacgggaccgccaacaguacacccaagcgaaagaccaacugcuggaccaacaggaccacccagugcagguccaacugguccaccuacagcaggcccaucuacugcaacaacagucccauuaaguccaguggacgaugcaugcaacguuaacauauucgacgcaauugcagaaauuggaaaucaauuauaucuuuuuaaagauggaaaauacuggagguucucagaaggaagagguucaagaccacaagguccauuucuuauagcugauaaauggccagcucuccccagaaaauuagacucaguauucgaagaacgauuaaguaaaaaauuauucuucuuuucaggcagacaaguuuggguauauacuggugcaaguguacucggaccaagaagacuugauaaauuaggcuuaggggcagacguugcacaaguaacuggagcccuaagauccggucgaggaaaaauguuauuauucucaggaagaagauuauggagauuugauguuaaagcacaaaugguugauccaagaucagcaucagaaguagacagaauguuuccaggcguaccacuagauacucaugacguauuucaauaucgggaaaaagcguacuuuugucaagauagauuuuauuggagaguuucuucaagaucagaauuaaaccaaguagaucaaguuggauauguaacauaugauauccuacaaugcccagaagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3687 - RNA, 1798 nt, Artificial Sequence
  mRNA product Design2 comprising derived and/or modified sequence from Homo sapiens__NP_002418.1__HsMMP13 (opt12)
ggggcgcugccuacggagguggcagccaucuccuucucggcaucaagcuuaccaugcacccaggaguacuagcagcauucuuauucuuaucuuggacccacuguagagcacuaccucuaccuagcggaggagaugaagaugaccucucagaagaagaccuacaauucgcagaaagauaucuacgaucuuauuaccacccaacaaacuuagcaggaauacuaaaagaaaacgcugcaucaucaaugacagaaagacuaagagaaaugcaaucauuuuucggacuagaaguaacaggaaaauuagacgacaacacauuagacguaaugaaaaaaccaagaugcggaguaccagaugucggagaauacaacgucuucccaagaacauuaaaauggagcaaaaugaaccuaacauauagaauaguaaauuacacacccgacaugacacacucagaaguagaaaaagcauuuaaaaaagcauucaaaguaugguccgaugucacaccccuaaacuucacaagauuacaugacggaauagcagacauaaugauaucuuucggaauaaaagaacacggugacuucuacccuuucgacggaccaucaggacuauuagcacacgcauucccacccggaccaaauuacggaggagaugcacacuuugacgaugaugaaacuuggacaucaucaucaaaagguuauaacuuauuucucguagcugcccacgaauucggacacucacuagggcuagaccacagcaaagaccccggagcauuaauguuuccaauuuauacauauacaggaaaaagucacuuuaugcuaccggacgacgacguacaaggcauacaaucacucuacgguccaggagacgaagacccaaacccaaaacaccccaaaacaccagauaaaugcgacccaucacuaucauuagaugcaauaacaucauuaagaggagaaacuaugauuuucaaagacagauucuucuggagguuacacccccaacaaguagaugcagaacucuuucuaacaaaaucauuuuggccagaauuaccaaauagaauugacgcugcauacgaacacccaucacacgaccuaauauuuauauucagaggaagaaaauucugggccuuaaacggauaugacauacuagaaggauacccaaaaaaaauaucagaauuaggucuacccaaagaaguaaaaaaaauaucagcagccguccacuucgaagacacuggaaaaacauuacucuuuaguggcaaccaaguauggagauaugacgauacaaaccacauaauggauaaagacuacccaagauuaauagaagaagacuuuccaggaauuggagacaaaguagacgccguauacgaaaaaaauggauacauauacuuuuucaacggaccaauucaauucgaauauuccauauggucaaaccgaauaguuaggguaaugccagcaaacuccauauuaugguguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3688 - RNA, 1450 nt, Artificial Sequence
  mRNA product Design2 comprising derived and/or modified sequence from Homo sapiens__NP_001286.1__HsCCR1 (opt12)
ggggcgcugccuacggagguggcagccaucuccuucucggcaucaagcuuaccauggaaacaccaaauacaacagaagacuaugacacaacuacagaauucgacuauggcgacgccacaccaugccaaaaaguaaacgaaagagcauucggcgcacaauuauuaccaccuuuauacucauuaguauucguaauaggauuaguaggaaacauacuaguaguauuaguacuaguacaauacaaaagacuaaaaaacaugacauccauauaccuacuaaacuuagcaauaucugaccuacuauuccuauucacucuaccauucuggaucgacuauaaacuaaaagaugacuggguuuucggugacgcaaugugcaaaauccucucaggauuuuacuacacaggauuauacagcgaaaucuuuuucaucauacuauuaaccaucgaccgauaccuagccauaguacacgcaguauucgcacucagagccagaacaguaacuuucggcguaauaacaucaauaauaaucugggcauuagccauacucgcaucaaugccaggacuauacuucucaaaaacacaaugggaauucacccaucacacaugcucauuacacuucccucacgaauccuuaagagaauggaaacuauuucaagcccuaaaauuaaacuuauucggacuaguacuaccuuuacuaguaaugauaaucuguuacacaggaauuauaaaaauacuacucagaagacccaacgaaaaaaaaucaaaagccguaagauuaauauucguaauaaugauaauuuucuucuuauucuggacaccauacaacuuaacaauacucauuuccgucuuccaagacuucuuauucacucacgaaugcgaacaaucaagacaucuagaccuagcaguccaagucaccgaaguaauagcauacacacacugcugcguaaacccaguaauuuacgcauucguaggagaacgauucagaaaauaccuuagacaacuuuuucacagaagaguagcaguccaccuugucaaauggcuaccauuuuuaucuguagacagacuagaaagaguaucuucaacaucaccaucuacaggagaacacgaacucucugccggcuuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3689 - RNA, 1018 nt, Artificial Sequence
  mRNA product Design2 comprising derived and/or modified sequence from Homo sapiens__NP_002598.4__HsPDGFA (opt12)
ggggcgcugccuacggagguggcagccaucuccuucucggcaucaagcuuaccaugcgaacacuagccugccuauuacuacuaggaugcggauaccuagcacacguacuagcagaagaagcagaaauaccaagagaaguaauagaaagacuagcaagaucacaaauacacaguauaagagaccuacaaagacuacuagaaauagacucaguaggaucagaagacucacuagacacaucacuaagagcacacggcguacaugcaacaaaacacguacccgaaaaaagaccauuaccaauaagaagaaaaagaagcauagaagaagccguaccagcaguauguaaaacaagaacaguaauauacgaaauaccaagaagccaaguagacccaacaucagccaacuucuuaauauggccaccaugcguagaaguaaaaagaugcacaggaugcugcaacacaagcagcgucaaaugccaaccaaguagaguacaccaucgaucaguaaaaguagcaaaaguagaauacgucagaaaaaaaccaaaacuaaaagaaguacaaguaagacucgaagaacaccuagaaugcgcaugcgccacaacaagccuaaacccagacuacagagaagaagacacaggaagaccaagagaaucaggaaaaaaacgaaaaagaaaaagacuaaaaccaacuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3690 - RNA, 1108 nt, Artificial Sequence
  mRNA product Design2 comprising derived and/or modified sequence from Homo sapiens__NP_002599.1__HsPDGFB (opt12)
ggggcgcugccuacggagguggcagccaucuccuucucggcaucaagcuuaccaugaacagaugcugggcacuauuccuaucauuaugcuguuacuuaagacuaguaucagcagaaggagauccaauaccagaagaauuauacgaaauguuaagugaucacucaauaagaagcuuugacgauuuacaaagacuacuacauggagauccaggagaagaagacggagcagaacuugaucuaaauaugacaagaucacacaguggaggagaauuagaaucacuagccagaggaagaagaagucuaggaucacucacaaucgcagaaccagcaaugauagcagaauguaaaacaagaacagaagucuucgaaaucucaagacgacuaauagacagaacaaaugcaaacuucuuaguauggccaccaugcguagaaguacaaagaugcucaggaugcugcaauaacaggaacguacaauguagaccaacacaaguacaacuaagacccgugcaaguaagaaaaauagaaauaguaagaaaaaaaccaaucuuuaaaaaagcaacaguaacacuagaagaucaucuagcaugcaaaugcgaaacaguagcagcugcaagaccaguaacaagaucaccaggaggaagccaagaacaaagagcaaaaacgccacaaacaagaguaacaauaagaacaguuagaguaagaagaccaccaaaaggaaaacauagaaaauucaaacacacacacgauaaaacagcauuaaaagaaacauuaggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3691 - RNA, 1420 nt, Artificial Sequence
  mRNA product Design2 comprising derived and/or modified sequence from Homo sapiens__NP_057289.1__HsPDGFC (opt12)
ggggcgcugccuacggagguggcagccaucuccuucucggcaucaagcuuaccaugucauuauucggauuauuacuuuuaacaucugcauuagcaggacaaagacaaggaacacaagcagaaucaaaccuaucaagcaaauuucaauuuucaucaaauaaagaacaaaauggcguacaagauccacaacacgaaagaauaauaacaguaagcacuaacggaucaauacacagcccccgauucccacauacauacccaagaaacacaguauuaguauggagauuagucgccguagaagaaaauguauggauacaacuuacauucgaugaaagauucggauuagaagaccccgaagacgacauaugcaaauacgacuucguagaaguagaagaacccucagacggaacaauauuaggucguuggugcggaucaggaacaguaccaggaaaacaaauaaguaaaggaaaccaaauaagaauucgauucguaucagaugaauacuuuccaucagaaccaggauucugcauccauuacaauauaguaaugccacaauuuacagaagcaguaucaccaagcguauuaccaccaucagcccuaccucuagacuuauuaaauaacgcaauaacagcauuuagcaccuuagaagacuuaauacgauacuuagaaccagaacgauggcaacuagaccuugaagaccuauacagaccaacauggcaauuacuaggaaaagcauucgucuuuggcagaaaaucaagaguaguagaucuaaaccuacuaacagaagaaguaagauuauacaguugcacaccuagaaacuucucaguaagcauaagagaagaacuaaaaagaacagacaccauauucuggccaggaugccuacuaguuaaaagaugcggaggaaauugcgcauguugcuuacacaacuguaacgaaugccaaugcguacccucaaaaguaacaaaaaaauaccacgaaguacuacaauuaagaccaaaaacaggaguaagaggacuccacaaaucacuuacagacguagcacuagaacaccacgaagaaugugacugcguaugcagaggcucaaccggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3692 - RNA, 1477 nt, Artificial Sequence
  mRNA product Design2 comprising derived and/or modified sequence from Homo sapiens__NP_149126.1__HsPDGFD (opt12)
ggggcgcugccuacggagguggcagccaucuccuucucggcaucaagcuuaccaugcauagauuaauauucguauacacacuaauaugugcaaacuucugcucaugcagagacaccagugcaacaccccaaagcgcaucaauaaaagcacuacgaaacgcaaacuuaagaagagacgaucuauauagaagagaugaaacaauacaaguaaaaggaaacggauacguacaaucaccacgauuuccaaauucauacccacgaaaccuauuauuaacauggcgacuacacucacaagaaaauacaagaauacaacuugucuucgacaaccaauucggacuagaagaagcagaaaaugacauaugcagauaugacuucguagaaguagaagacauaucagaaacuucaacaauaauaagaggaagaugguguggacacaaagaagucccaccaagaauaaaaucaagaacaaaccaaauaaaaauaaccuucaaaucagaugacuacuucguagcaaaaccgggcuuuaaaauauacuauagccuauuagaagacuuccaaccagcagcagcaucagaaaccaacugggaaucaguaacaagcucaauaucuggaguaucauacaacucaccaucaguaacagauccaacacuaauagcagacgcauuagacaaaaaaauagccgaauucgacacaguagaagaucuacuaaaauacuucaacccagaaucauggcaagaagaccuagaaaacauguaccuagacacaccaagauacagaggaagaucauaccaugacagaaaaaguaaaguagaccuagacagacuaaacgacgaugcaaaaagauacagcugcacaccaagaaauuacucaguaaacauaagagaagaacuaaaacuagcaaacguaguauucuucccaagaugcuuauuaguacaaaggugcggaggaaauuguggaugcggaacaguaaacuggagauccuguacaugcaacucaggcaaaacagucaaaaaauaccacgaaguacuacaauucgaaccaggacacauaaaaagaagaggcagagcaaaaacaauggcacuaguagacauacaacucgaucaccacgaaagaugcgacuguauaugcucaagcagaccaccacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3693 - RNA, 1060 nt, Artificial Sequence
  mRNA product Design2 comprising derived and/or modified sequence from Homo sapiens__NP_003946.3__HsSOCS3 (opt12)
ggggcgcugccuacggagguggcagccaucuccuucucggcaucaagcuuaccaugguaacacacucaaaauucccagcagcaggaaugucacgaccucuagacacaucauuacgacuaaaaacauucucaucaaaaucugaauaccaacuaguaguaaacgcaguaagaaaauuacaagaaucaggauucuacuggucagcaguaacaggaggagaagcaaaccuacuauuaucagcagaaccagcaggaacauuccuaauaagagacucaucagaccaaagacacuucuuuacacuaucaguaaaaacccaaucuggaacaaaaaaccuacgaauacaaugugaaggaggauccuucucucuacaaucagacccaagaucaacacaaccaguacccagauuugacugcguacuaaaauuaguacaccacuacaugcccccacccggagcaccaucauucccaucacccccaacagaacccucaucagaaguaccagaacaaccaucagcacaaccacuaccaggcucaccaccaagaagagcuuauuacauauacuccggaggagaaaaaauaccacuaguucuaucaagacccuuaucaucaaacguagccacacuacaacaccuaugcagaaaaacaguaaacggacacuuagacucauacgaaaaaguaacacaacuuccaggaccaauaagagaauucuuagaucaauacgacgcaccauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3694 - RNA, 865 nt, Artificial Sequence
  mRNA product Design2 comprising derived and/or modified sequence from Homo sapiens__NP_003227.1__HsTGFA (opt12)
ggggcgcugccuacggagguggcagccaucuccuucucggcaucaagcuuaccaugguaccaucagcaggacaauuagcauuauucgcauuaggaauaguauuagcagcaugucaagcauuagaaaauucaacaucaccauuaucagcagacccaccaguagcagcagcaguaguaucacauuuuaaugauugcccagauucacauacacaauucugcuuucauggaacauguagauuuuuaguacaagaagauaaaccagcauguguaugucauucaggauauguaggagcaagaugugaacaugcagauuuauuagccguaguagcagcaucacaaaaaaaacaagcaauaacagcauuaguaguaguaaguauaguagcauuagcagucuuaauaauaacauguguauuaauacauuguugucaaguaagaaaacauugugaauggugcagagcauuaauauguagacaugaaaaaccaucagcacuauuaaaaggaagaacagcauguugucacucagaaacaguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3695 - RNA, 1555 nt, Artificial Sequence
  mRNA product Design2 comprising derived and/or modified sequence from Homo sapiens__NP_000651.3__HsTGFB1 (opt12)
ggggcgcugccuacggagguggcagccaucuccuucucggcaucaagcuuaccaugccaccaaguggauuaagacuacuaccauuacuauuaccacuauuauggcuacuaguauuaacaccuggaagaccagcugcaggccuaucaaccugcaaaacaauagacauggaacuaguaaaacgaaaaagaauagaagcaauaagaggccaaauacuaucaaaacuaagauuagcaucaccaccuucccaaggagaaguaccaccaggcccacuaccagaagcaguacuagcacuauacaacuccacaagagacagaguagcaggcgaaucagccgaaccagaaccagaaccagaagcugacuacuacgcaaaagaaguaacuagaguauuaaugguagaaacacacaacgaaaucuaugacaaauuuaaacaaucuacacauucuauauauauguucuucaauacaagcgaauuacgagaagcaguacccgaaccaguacuauuaucaagagcugaacuccgauuacuaagauuaaaacuaaaaguagaacaacacguagaacuauaccaaaaauauucuaauaauucauggagauaucuuagcaauagauuacuagcaccauccgacucaccugaauggcuaucauuugauguaacaggaguaguacgucaauggcuaucacgaggcggagaaauagaaggauuuagauuaagcgcucacugcagcugugacucaagagacaacacauuacaaguagacaucaacggauucacaacaggaagaagaggagaucuagccacaauacacggaaugaacagaccauuucuacuauuaauggcaacaccacuagaaagagcacaacaucuacaaucuucaagacacagaagagcauuagacacaaacuacugcuuuucaagcacagaaaaaaauugcugcgucagacaauuauauauagauuucagaaaagauuuaggcuggaaauggauacaugaaccaaaaggauaccacgcaaacuucugccuaggaccaugcccauacauuuggucauuagauacccaauacucaaaaguucuugcauuauacaaccaacacaacccuggagcaagugcagcaccauguugcguaccccaagcauuagaaccacuaccaauaguauauuacguuggccgaaaacccaaaguagaacaacuaucaaacaugauagucagaucauguaaauguucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3696 - RNA, 1627 nt, Artificial Sequence
  mRNA product Design2 comprising derived and/or modified sequence from Homo sapiens__NP_003229.1__HsTGFB2 (opt12)
ggggcgcugccuacggagguggcagccaucuccuucucggcaucaagcuuaccaugcacuacugcguacucucagccuuccuaauacuacaccuaguaacaguagcauuaagcuuaucaacaugcucaacacuagacauggaucaauucaugagaaaaagaauagaagcaauaagaggccaaauacuaucaaaacuuaaauuaacaucaccaccagaagacuaucccgaaccagaagaaguaccaccagaaguaauaucaauauauaacucaacaagagaccuauuacaagaaaaagcaagccgaagagcagcagcaugcgaacgagaaaggucagacgaagaauacuacgccaaagaaguauacaaaauagacaugccacccuucuucccaucagaaaaugccauaccccccacauuuuacagaccauacuucagaaucguaagauucgacguaucagcaauggaaaaaaacgcaucaaaucuaguuaaagcagaauucagaguauucagacuacaaaacccaaaagcaagaguaccagaacaaagaauagaacuauaccaaauacuuaaauccaaagaucuaacaucaccuacacaaagauauauagacucaaaaguaguaaaaacuagagcagaaggcgaauggcuauccuucgacguaacagacgccguucacgaauggcuucaccacaaagaccgaaacuuaggauucaaaauaucacuucacuguccauguugcacauuuguccccucaaauaacuacauaauccccaauaaaucagaagaacucgaagcaagauucgccggaauagacggaacuagcacauauaccuccggagaccaaaaaaccauaaaaucuacaagaaaaaaaaacucuggaaaaacaccacacuuacuauuaaugcuacuacccucauaccgacucgaaucucaacaaacaaacagacgaaaaaaaagagcauuagacgccgcuuauuguuucagaaauguacaagauaacugcugccuacgaccacuauacauagauuucaaaagagaucuaggcuggaaauggauccaugaaccaaaaggcuauaacgcaaacuucugcgcuggagcaugcccauaccuauggucaucagacacacaacauucaagaguauuaucacuuuacaacaccauaaaucccgaagcaucagcaagccccuguugcguaucacaagaccuagaaccacuaaccauccuauacuauauaggaaaaacuccaaaaauagaacaacuaucuaauaugauaguaaaaucaugcaaaugcucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3697 - RNA, 1621 nt, Artificial Sequence
  mRNA product Design2 comprising derived and/or modified sequence from Homo sapiens__NP_003230.1__HsTGFB3 (opt12)
ggggcgcugccuacggagguggcagccaucuccuucucggcaucaagcuuaccaugaaaaugcacuuacaaagagcccuaguaguccuagcuuuacuuaacuucgcaaccguaucccuaagccuaucaacuuguacaacccuagacuuuggacacauaaaaaaaaaacgcguagaagcaauuagaggacaaauauuaucuaaacuaagauuaaccucaccaccagaaccaacaguaaugacacauguaccauaccagguauuagcacuauacaauucaacacgcgaacuacuagaggaaaugcauggagaaagagaagaaggaugcacacaagaaaacacagaaucagaauacuacgcaaaagaaauccauaaauucgacaugauacaaggauuagcagaacacaacgaacuagcaguaugcccaaaaggaauaacaucaaaaguauuuagauucaauguaucuucaguugaaaaaaauagaacuaaccucuuuagagccgaauuccgcguauuaagaguccccaacccaagcagcaaacgaaacgaacaaagaauagaacuauuccaaauacuaaggccagacgaacacauagcaaaacaaagauauauaggaggcaaaaauuuacccacaagagguacagcagaauggcuaucauucgauguaacagauaccguaagagaauggcuacuaagaagagaaaguaaucuaggccuagaaauaucaauacauuguccaugucacacauuccaaccaaacggagacauauuagaaaacauacacgaaguaauggaaauaaaauucaaaggaguagacaacgaagaugaucacggacgaggcgaucuaggcagauuaaaaaaacaaaaagaccaccacaauccacaccuaauauuaaugaugauaccaccacacagacuagacaauccaggccagggaggccaaagaaaaaaaagggcacuagacaccaacuacugcuucagaaaccuagaagaaaacugcugcguaagaccacuauacauugacuucagacaagaccuaggcuggaaauggguccaugaaccaaaaggauacuacgccaacuuuugcucaggaccaugcccauaccucagaucagcagacacaacccacucaacaguauuagguuuauacaacacauuaaacccagaagcaagugccuccccuuguugcguaccacaagaccuagaaccauuaaccauauuauauuauguaggacgaacaccaaaaguagaacaacuaucaaauaugguaguaaaaucaugcaaauguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3698 - RNA, 1768 nt, Artificial Sequence
  mRNA product Design2 comprising derived and/or modified sequence from Homo sapiens__NP_001057.1__HsTNFRSF1B (opt12)
ggggcgcugccuacggagguggcagccaucuccuucucggcaucaagcuuaccauggcuccuguagccguaugggcagcucuagccguaggauuagaauuaugggcugcugcccaugcacuaccugcccaaguugcuuuuacaccauacgcaccagaaccugguucaacauguagauuaagagaauauuaugaucaaacugcucaaauguguuguucaaaauguagcccuggucaacaugccaaaguauucuguacuaaaacuucugauaccguaugugauucaugugaggauucaacauauacacaauuauggaauuggguaccagaauguuuaucauguggaucucgauguucaucagaucaaguagaaacacaagcuuguacaagagaacaaaauagaauauguacuuguagaccagguugguacugcgccuuaucaaaacaagaaggauguagacuaugcgccccacuacgaaaauguagaccaggauuugguguugcacguccaggaacagaaacaucagacguaguauguaaaccaugcgcucccgguacauucucaaauacaacaucauccaccgauauaugucgaccacaucaaauauguaauguaguagcaauaccaggaaaugcaucuauggacgcaguauguacaucaacaucacccacaagaucaauggcaccaggugcuguccaucuaccacaaccuguuucaacaagaucacaacauacacaaccuacacccgaaccauccacagcaccaaguaccucauuucuuuuaccuaugggaccaucaccaccugcagaaggaucaacaggagauuuugcacuuccaguaggacuaauaguuggaguaacugcacuaggauuauuaauaauuggagucguaaauuguguaauaaugacacaaguaaaaaaaaaaccauuaugcuuacaacgagaagccaaagucccucauuuaccagcagacaaagcuagaggaacccaaggaccagaacaacaacaccuacucauaaccgcaccuucaucaucuucaucaucuuuagaaucaucugcaucugcauuagauagaagagcacccacaagaaaucaaccacaagcaccuggaguugaagcuuccggggcaggugaagcucgagcuucaacaggaucuucagauucaucuccagguggucauggaacccaaguuaauguaacuugcaucguaaauguauguucaucaucagaucacucaucacaauguucaucacaagcaaguucaacuaugggagauacugacucaagcccaucggaaucaccuaaagaugaacaaguaccauuuaguaaagaagaaugugcauuuagaucucaacuugaaacaccagaaacuuuauuaggaaguacagaagaaaaaccacuaccauuaggaguacccgaugcagggaugaaaccuuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3699 - RNA, 895 nt, Artificial Sequence
  mRNA product Design2 comprising derived and/or modified sequence from Homo sapiens__NP_002623.2__HsPGF (opt12)
ggggcgcugccuacggagguggcagccaucuccuucucggcaucaagcuuaccaugccaguaaugaggcuauuuccauguuuuuuacaauuacuagcaggauuagcauuaccagcaguaccaccacaacaaugggcauuaagugcaggaaauggaaguucagaaguagaaguaguaccauuucaagaaguauggggaagaucauauuguagagcacuugaaagauuaguagauguaguaagugaauauccaagcgaaguagaacauauguuuucaccaucauguguaaguuuauuaagauguacaggauguuguggagaugaaaaucuacauuguguaccaguagaaacagcaaauguaacaaugcaauuacuaaaaauaagaaguggagauagaccaucauauguagaauuaacauucagucaacauguaagaugugaauguagaccauuaagagaaaaaaugaaaccagaaagaagaagaccaaaaggaagaggaaaaagaagaagagaaaaacaaagaccaacagauugccauuuauguggagaugcaguaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3700 - RNA, 1621 nt, Artificial Sequence
  mRNA product Design2 comprising derived and/or modified sequence from Homo sapiens__NP_001020537.2__HsVEGFA (opt12)
ggggcgcugccuacggagguggcagccaucuccuucucggcaucaagcuuaccaugacagacagacaaacagauacagcaccuucaccaagcuaucacuuauuaccugguagaagaagaacaguagaugcagcagcuaguaggggacaaggaccagaaccagcuccaggaggagguguagaaggaguaggggcaagaggaguagcuuuaaaauuauuuguacaacuuuuaggauguagcagguuuggaggagcgguuguaagagccggugaagcagaaccgucaggagcagcaagaucagcaagcucaggaagggaagaaccacaaccagaagaaggugaagaagaagaagaaaaggaagaagaaaggggaccacaauggcgacugggagcaagaaagccagguaguuggacaggagaagcagcaguaugcgcagacucugcaccagcagcaagagcaccgcaagcauuagcucgagcaaguggaaggggaggaagaguagcucgaagaggagcagaagaaucaggaccuccacacaguccaaguaggagaggaagugcaagcagggcaggaccagggagagcaagcgaaacaaugaauuuucuauugaguuggguacauuggagccuagcccuauuauuauauuuacaucaugcuaaauggucacaagcagcaccaauggcagaaggaggaggacaaaaucaucaugagguagugaaauuuauggauguauaucaaagaucauauugucauccaauagaaacauuaguugacauauuucaagaauauccagaugaaauagaauauaucuuuaaaccuagcugugucccauugaugagauguggaggauguuguaaugaugagggauuagaaugcguaccaacagaagaaaguaacauaacaaugcaaauaaugcgaauaaaaccacaucaaggacaacauauaggagaaaugucauuuuugcaacauaacaaaugcgaaugcaggccaaaaaaagacagagcaagacaagaaaaaaaaaguguuagaggaaaaggaaaaggucaaaaaaggaaaagaaaaaaaaguagauauaaaaguuggaguguauauguaggagcaagauguuguuuaaugccauggagucuaccgggaccacauccauguggaccuugcagugagaggagaaaacacuuauuuguucaagacccacaaacauguaaauguucuuguaaaaacacugauagcagauguaaagcucgacaauuggaauuaaaugaaaggacauguagaugugauaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3701 - RNA, 1081 nt, Artificial Sequence
  mRNA product Design2 comprising derived and/or modified sequence from Homo sapiens__NP_001165094.1__HsVEGFA (opt12)
ggggcgcugccuacggagguggcagccaucuccuucucggcaucaagcuuaccaugaacuuccuauuaagcuggguacacuggucacuagcauuauuauuauauuuacaucacgccaaauggucacaagcagcaccaauggcagaaggaggaggacaaaaccaccacgaaguaguaaaauuuauggauguauaccaaagaagcuauugccauccaauagaaacacuaguagacauauuccaagaauauccagaugaaauagaauauauauuuaaaccauccugcguaccauuaaugagaugcggaggaugcugcaacgacgaaggacuagaaugcguaccaacagaagaaaguaauauaacaaugcaaauaaugagaauaaaaccacaccaaggacaacacauaggcgaaaugaguuucuuacaacauaacaaaugcgaaugcagaccaaaaaaagacagagcaagacaagaaaaaaaaagcguaagaggaaaaggaaaaggacaaaaaagaaaaagaaaaaaaagcagauacaaaagcuggagcguauacguaggagcaagaugcugcuuaaugccauggucacuaccaggaccacacccaugcggaccauguucagaaagaagaaaacaucuauuuguacaagacccacaaacauguaaaugcucaugcaaaaacaccgacaguagauguaaagcaagacaacuagaacuaaaugaaagaaccuguagaugugacaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3702 - RNA, 1006 nt, Artificial Sequence
  mRNA product Design2 comprising derived and/or modified sequence from Homo sapiens__NP_003368.1__HsVEGFB (opt12)
ggggcgcugccuacggagguggcagccaucuccuucucggcaucaagcuuaccaugucaccacuauuaagaagacuacuauuagcagcauuacuacaacuagcaccagcacaagcuccaguaagccaaccagacgcacccggacaucaaagaaaaguaguaucauggauagauguauacacaagagcaacaugucaaccaagagaaguuguagucccacuaacaguagaauuaaugggaacaguagcaaaacaauuaguaccaucaugcguaaccguacaaagaugcggaggauguugcccagacgauggcuuagaaugcguaccaacuggacaacaucaaguaagaaugcaaauacuaaugauaagauacccaucaucacaauuaggagaaaugucauuagaagaacauucacaaugcgaaugcagaccaaaaaaaaaagacucagcaguaaaaccagacagagcagcaacaccacaucauagaccacaaccaagaucaguaccaggaugggacucagcaccaggagcaccaucuccagcagacauaacacauccaacaccagcaccaggaccaucagcacaugcagcacccucaacaacaagugcacuaacaccaggaccagcagcagcagcagcugacgcagcagcaucaucagucgcaaaaggaggagccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3703 - RNA, 1642 nt, Artificial Sequence
  mRNA product Design2 comprising derived and/or modified sequence from Homo sapiens__NP_005420.1__HsVEGFC (opt12)
ggggcgcugccuacggagguggcagccaucuccuucucggcaucaagcuuaccaugcaccuauuaggauucuuuagcguagcgugcaguuuauuggcagcagcacuauuaccagguccacgugaagcaccagccgcagccgcagcuuucgaaucaggauuagacuuaagcgacgcugaacccgacgcaggcgaagcaacagcauacgcuucaaaagaucuagaagaacaacuaagaucuguaucuucaguagacgaauuaaugacaguacuauacccagaauauuggaaaauguauaaaugccaacuaagaaaaggagguuggcaacacaauagagaacaagcaaacuuaaacuccagaacagaagagacuauaaaauuugcagcagcacauuacaacacagaaauucuaaaaucaauagacaaugaauggagaaaaacucaauguaugccaagagaaguaugcauagacguagguaaagaauucgguguagccaccaacacauuuuuuaaaccaccaugcguaucaguauauagaugcggaggcuguugcaauucagaaggauuacaauguaugaauaccucuacaagcuaccuaucaaaaacacuauucgaaauaacuguaccauuaucacaaggaccaaaaccaguaacaauaucauuugcaaaccacacaucaugucgaugcaugucaaaauuagacguauaccgacaaguacacaguauaauaagaagaucacuacccgcaacacuaccacaaugccaagcagcaaauaaaacaugcccaacuaacuacauguggaauaaucauauuuguagaugccuagcacaagaagauuucauguucucaagugaugcaggugacgacucuacugacggauuucaugacauauguggaccaaauaaagaacuagacgaagaaacaugucaaugcguaugcagagcaggacuucgaccagcauccugugguccacauaaagaacuagauagaaauucaugccaauguguuuguaaaaauaaauuauuccccagccaaugcggagcaaauagagaauuugaugaaaauacaugccaauguguauguaaaagaaccugcccaagaaaucaaccacuaaacccaggaaaaugcgccugcgaaugcacagaaaguccacaaaaaugucuauuaaaagguaaaaaauuccaucaccaaacauguucaugcuacagaagaccaugcacaaacagacaaaaagcaugugaaccuggauuuucauauucagaagaaguuuguagauguguuccaucauacuggaaacgaccacaaaugagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3704 - RNA, 1447 nt, Artificial Sequence
  mRNA product Design2 comprising derived and/or modified sequence from Homo sapiens__NP_004460.1__HsVEGFD (opt12)
ggggcgcugccuacggagguggcagccaucuccuucucggcaucaagcuuaccauguacagagaauggguaguaguaaacguauucaugaugcuauauguacaacuuguacaaggaagcucaaaugaacacggaccaguaaaaagaucaucacaguccacacuagaaagaucagaacaacaaauaagagcagcauccucucuagaagaauuacuaagaaucacacauuccgaagacuggaaauuauggcgaugucgacuacgcuuaaaaagcuuuacuaguauggacucacgcucagcaucacauagaaguacaagauuugcagcaacauucuacgacauagaaacacuaaaaguaauagaugaagaauggcaaagaacacaaugcucaccaagagaaacaugcgucgaaguagcaucugaacucggaaaauccaccaauacauucuucaaaccaccaugcguuaacguauuuagaugcggaggauguugcaacgaagaaucacuaauaugcaugaauacauccacaucauacauaucaaaacaacuauucgaaauauccguaccauuaacaucaguaccagaacuaguaccaguaaaaguagcaaaucacacaggaugcaaaugccuaccaacagcaccaagacacccuuacagcauaauaagaagaucaauacaaauacccgaagaagacagaugcucccacagcaaaaaauuaugcccaaucgacaugcuaugggacucaaacaaaugcaaaugcguacuacaagaagaaaacccacuagcagguacagaagaccacucacaccuacaagaaccagcauuaugcgguccucacaugauguucgacgaagauagaugcgaaugcguaugcaaaacaccauguccaaaagacuuaauacaacacccaaaaaauugcuccuguuuugaauguaaagaaucacuagaaacaugcugccaaaaacacaaauuauuucaucccgauacaugcucaugcgaagacagaugcccauuccacacaagaccaugcgcaaguggaaaaacagccugcgccaagcacugccgauucccaaaagaaaaaagagcagcucaaggaccacacucacgaaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3705 - RNA, 1012 nt, Artificial Sequence
  mRNA product Design2 comprising derived and/or modified sequence from Homo sapiens__NP_061986.1__HsFGF21 (opt13)
ggggcgcugccuacggagguggcagccaucuccuucucggcaucaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3706 - RNA, 1792 nt, Artificial Sequence
  mRNA product Design2 comprising derived and/or modified sequence from Homo sapiens__NP_002412.1__HsMMP1 (opt13) R4749
ggggcgcugccuacggagguggcagccaucuccuucucggcaucaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3707 - RNA, 1552 nt, Artificial Sequence
  mRNA product Design2 comprising derived and/or modified sequence from Homo sapiens__NP_002412.1__HsMMP1(1-19,100-469) (opt13) R4751
ggggcgcugccuacggagguggcagccaucuccuucucggcaucaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3708 - RNA, 3739 nt, Artificial Sequence
  mRNA product Design2 comprising derived and/or modified sequence from Clostridium histolyticum__BAA77453.1__ColG (opt13)
ggggcgcugccuacggagguggcagccaucuccuucucggcaucaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3709 - RNA, 3463 nt, Artificial Sequence
  mRNA product Design2 comprising derived and/or modified sequence from Clostridium histolyticum__BAA77453.1__HsALB(1-18)_ColG(111-1118) (opt13)
ggggcgcugccuacggagguggcagccaucuccuucucggcaucaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3710 - RNA, 3811 nt, Artificial Sequence
  mRNA product Design2 comprising derived and/or modified sequence from Clostridium histolyticum__BAA77453.1__HsALB(1-18)_ColG(1-110)_CS-F_ColG(111-1 118) (opt13)
ggggcgcugccuacggagguggcagccaucuccuucucggcaucaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3711 - RNA, 3487 nt, Artificial Sequence
  mRNA product Design2 comprising derived and/or modified sequence from Clostridium histolyticum__BAA34542.1__ColH (opt13)
ggggcgcugccuacggagguggcagccaucuccuucucggcaucaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3712 - RNA, 3448 nt, Artificial Sequence
  mRNA product Design2 comprising derived and/or modified sequence from Clostridium histolyticum__BAA34542.1__ColH (opt13)
ggggcgcugccuacggagguggcagccaucuccuucucggcaucaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3713 - RNA, 3382 nt, Artificial Sequence
  mRNA product Design2 comprising derived and/or modified sequence from Clostridium histolyticum__BAA34542.1__HsALB(1-18)_ColH(41-1021) (opt13)
ggggcgcugccuacggagguggcagccaucuccuucucggcaucaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3714 - RNA, 3520 nt, Artificial Sequence
  mRNA product Design2 comprising derived and/or modified sequence from Clostridium histolyticum__BAA34542.1__HsALB(1-18)_ColH(1-40)_CS-F_ColH(41-102 1) (opt13)
ggggcgcugccuacggagguggcagccaucuccuucucggcaucaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3715 - RNA, 958 nt, Artificial Sequence
  mRNA product Design2 comprising derived and/or modified sequence from Homo sapiens__NP_001133.1__HsAMELX (opt13)
ggggcgcugccuacggagguggcagccaucuccuucucggcaucaagcuuaccaugggaacauggauauuauucgcaugccuacuaggagcagcauucgcaaugccacuaccaccacacccaggacacccaggauacauaaacuucucauacgaaguacuaacaccacuaaaaugguaccaaucaauacgacccccauacccaucauacggauaugaacccaugggaggauggcuacaccaccaaauaauaccaguacuaucacaacaacaucccccaacacacacauuacaaccucaccaccacauaccaguaguaccagcacaacaaccaguaauaccacaacaaccaaugaugccaguaccaggacaacacucaaugacaccaauacaacaccaccaaccaaaccuaccaccaccagcccaacaaccauaccaaccacaaccaguacaaccacaaccacaccaaccaaugcaaccacaaccaccaguacacccaaugcaaccacuaccaccacaaccaccacuaccaccaauguucccaaugcaaccacuaccaccaaugcuaccagaccuaacacucgaagcauggccaucaaccgauaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3716 - RNA, 517 nt, Artificial Sequence; identical to SEQ ID NO: 3164
  mRNA product Design2 comprising derived and/or modified sequence from Homo sapiens__NP_001133.1__HsAMELX-TRAP (opt13)

SEQ ID NO: 3717 - RNA, 550 nt, Artificial Sequence; identical to SEQ ID NO: 3165
  mRNA product Design2 comprising derived and/or modified sequence from Homo sapiens__NP_001133.1__HsAMELX-LRAP (opt13)

SEQ ID NO: 3718 - RNA, 589 nt, Artificial Sequence; identical to SEQ ID NO: 3166
  mRNA product Design2 comprising derived and/or modified sequence from Homo sapiens__NP_001133.1__HLA-A2-SP_HsAMELX(17-60) (opt13)

SEQ ID NO: 3719 - RNA, 622 nt, Artificial Sequence; identical to SEQ ID NO: 3627
  mRNA product Design2 comprising derived and/or modified sequence from Homo sapiens__NP_001133.1__HLA-A2-SP_HsAMELX(17-47,168-191) (opt13)

SEQ ID NO: 3720 - RNA, 961 nt, Artificial Sequence
  mRNA product Design2 comprising derived and/or modified sequence from Homo sapiens__NP_001134.1__HsAMELY (opt13)
ggggcgcugccuacggagguggcagccaucuccuucucggcaucaagcuuaccaugggaacauggauacuauucgcaugccuaguaggagccgcauucgcaaugccacuaccaccacauccaggacacccaggauauauaaacuucucauacgaaguauuaacaccacucaaaugguaccaauccaugauaagacccccauacucaucauacggauacgaaccaaugggcggauggcuacaccaccaaauaaucccaguaguaucccaacaacacccacuaacacacacauuacaaucacaccaccacauaccaguaguaccagcacaacaaccaagaguaagacaacaagcauuaaugccaguaccaggacaacaaucaaugacaccaacacaacaccaccaaccaaaccuaccacuaccagcacaacaacccuuccaaccucaaccaguacaaccacaaccacaccaaccaaugcaaccacaaccaccaguacaaccaaugcaaccacuauuaccacaaccaccacuaccacccauguucccacuaagaccauuaccaccaauacuaccagaccuacaccuagaagccuggccagcaacagacaaaacaaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3721 - RNA, 520 nt, Artificial Sequence; identical to SEQ ID NO: 3169
  mRNA product Design2 comprising derived and/or modified sequence from Homo sapiens__NP_001134.1__HsAMELY-TRAP (opt13)

SEQ ID NO: 3722 - RNA, 553 nt, Artificial Sequence; identical to SEQ ID NO: 3630
  mRNA product Design2 comprising derived and/or modified sequence from Homo sapiens__NP_001134.1__HsAMELY-LRAP (opt13)

SEQ ID NO: 3723 - RNA, 592 nt, Artificial Sequence
  mRNA product Design2 comprising derived and/or modified sequence from Homo sapiens__NP_001134.1__HLA-A2-SP_HsAMELY(17-61) (opt13)
ggggcgcugccuacggagguggcagccaucuccuucucggcaucaagcuuaccauggcaguaauggcaccaagaacacuaguacuacuacuaucaggagcacuagcacuaacacaaacaugggcaaugccacuaccaccacacccaggacacccaggauauauaaauuucucauacgaaguacuaacaccacuaaaaugguaucaaucaaugauaagaccaccauacucaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3724 - RNA, 625 nt, Artificial Sequence
  mRNA product Design2 comprising derived and/or modified sequence from Homo sapiens__NP_001134.1__HLA-A2-SP_HsAMELY(17-48,169-192) (opt13)
ggggcgcugccuacggagguggcagccaucuccuucucggcaucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3725 - RNA, 952 nt, Artificial Sequence
  mRNA product Design2 comprising derived and/or modified sequence from Sus scrofa__NP_999071.1__SsAMELX-001-1 (opt13)
ggggcgcugccuacggagguggcagccaucuccuucucggcaucaagcuuaccaugggaacauggauacuauucgcaugccuacuaggagcagcauucucaaugccacuaccaccacacccaggacauccaggauacauaaacuucucauacgaaguacucacaccauuaaaaugguaccaaaacaugauaagacacccauacacaucauacggauacgaaccaaugggcggauggcuacaccaccaaauaauaccaguaguaucacaacaaaccccacaaucacacgcauuacaaccacaccaccauauaccaaugguaccagcacaacaaccaggaauaccacaacaaccaaugaugccacuaccaggacaacacucaaugacaccaacccaacaccaccaaccaaaccuaccccuacccgcacaacaaccauuccaaccacaaccaguacaaccccaaccacaccaacccuuacaaccacaaucaccaaugcacccaauacaaccacuacucccacaaccaccacuaccaccaauguucucaaugcaaucacuacuaccagaccuaccauuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3726 - RNA, 520 nt, Artificial Sequence; identical to SEQ ID NO: 3174
  mRNA product Design2 comprising derived and/or modified sequence from Sus scrofa__NP_999071.1__SsAMELX-TRAP (opt13)

SEQ ID NO: 3727 - RNA, 553 nt, Artificial Sequence
  mRNA product Design2 comprising derived and/or modified sequence from Sus scrofa__NP_999071.1__SsAMELX-LRAP (opt13)
ggggcgcugccuacggagguggcagccaucuccuucucggcaucaagcuuaccaugccacuaccaccacacccaggacacccaggauacauaaacuucucauacgaaguacuaacaccacuaaaaugguaccaaaacaugauaagacacccaucacuacuaccagaccuaccauuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3728 - RNA, 592 nt, Artificial Sequence; identical to SEQ ID NO: 3176
  mRNA product Design2 comprising derived and/or modified sequence from Sus scrofa__NP_999071.1__HLA-A2-SP_SsAMEL(17-61) (opt13)

SEQ ID NO: 3729 - RNA, 625 nt, Artificial Sequence
  mRNA product Design2 comprising derived and/or modified sequence from Sus scrofa__NP_999071.1__HLA-A2-SP_SsAMEL(17-49,167-189) (opt13)
ggggcgcugccuacggagguggcagccaucuccuucucggcaucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3730 - RNA, 916 nt, Artificial Sequence
  mRNA product Design2 comprising derived and/or modified sequence from Sus scrofa__P45561-2__SsAMELX-001-2 (opt13)
ggggcgcugccuacggagguggcagccaucuccuucucggcaucaagcuuaccaugggaacauggauacuauucgcaugccuauuaggagcagcauucucaaugccacuaccaccacacccaggacacccaggauauauaaacuucucauacauaagacacccauacacaucauacggauacgaaccaaugggaggauggcuacaccaccaaauaauuccaguaguaucacaacaaacaccacaaucacacgcacuacaaccacaccaccacauaccaaugguaccagcacaacaaccaggaauaccacaacaaccaaugaugccacuacccggacaacacucaaugacacccacacaacaccaccaaccaaaccuaccacuaccagcacaacaaccauuccaaccacaaccaguacaaccacaaccacaccaaccauuacaaccacaaucaccaaugcacccaauacaaccacuacuaccacaaccaccacuaccacccauguucucaaugcaaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3731 - RNA, 952 nt, Artificial Sequence
  mRNA product Design2 comprising derived and/or modified sequence from Sus scrofa__NP_998965.1__SsAMELX-001-3 (opt13)
ggggcgcugccuacggagguggcagccaucuccuucucggcaucaagcuuaccaugggaacauggauauucuucgcaugccuauuaggagcaucccuagcaaugccacuaccaccacacccaggacacccaggauacauaaacuucucauacgaaguacucacaccauuaaaaugguaccaaaacaugauaagacacccauacacaucauacggauacgaaccaaugggaggcuggcuacaccaccaaauaauaccaguaguaucacaacaaacaccacaaucacacgcacuacaaccacaucaccacauaccaaugguaccagcccaacaaccaggaauaccacaacaaccaaugaugccacuaccaggacaacacucaaugacaccaacacaacaccaccaaccaaaccuaccacuaccagcacaacaaccauuccaaccacaaccaguacaaccacaaccccaccaaccacuacaaccacaaucaccaaugcacccaauccaaccacuacuaccacaaccaccacuaccaccaauguucucaaugcaaucccuacuacccgaccuaccacuagaagccuggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3732 - RNA, 601 nt, Artificial Sequence; identical to SEQ ID NO: 3180
  mRNA product Design2 comprising derived and/or modified sequence from Sus scrofa__K7GPB2__SsAMELX-002 (opt13)

SEQ ID NO: 3733 - RNA, 994 nt, Artificial Sequence
  mRNA product Design2 comprising derived and/or modified sequence from Sus scrofa__K7GLD0__SsAMELX-003 (opt13)
ggggcgcugccuacggagguggcagccaucuccuucucggcaucaagcuuaccaugggaacauggauacuauucgcaugccuauuaggagcagcauucucaaugccacuaccaccacacccaggacacccaggauacauaaacuucucauacgaagaccuauacuuagaagcaauaagaauagacagaacagcauucguacuaacaccacuaaaaugguaccaaaacaugauaagacacccauacacaucauacggcuacgaaccaaugggaggauggcuacaccaccaaauaauaccagucguaucccaacaaacaccccaaucacacgcauuacaaccacaccaccacauaccaauggucccagcacaacaaccagguauaccccaacaaccaaugaugccacuaccaggacaacacucaaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccacaaccaccauuaccacccauguucucaaugcaaucacuauuacccgaccuuccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3734 - RNA, 880 nt, Artificial Sequence
  mRNA product Design2 comprising derived and/or modified sequence from Sus scrofa__K7GPE9__SsAMELX-004 (opt13)
ggggcgcugccuacggagguggcagccaucuccuucucggcaucaagcuuaccaugggaacauggauacucuucgcaugccuacuaggcgcagcauucuccaugccacuaccaccacacccaggacaccccggauacauaaacuucucauacgaaguacucacaccacuaaaaugguaccaaaacaugauaagacacccaacaccacaaucacacgcacuacaaccacaccaccacauaccaaugguaccugcacaacaaccaggaauaccacaacaaccaaugaugccacuaccaggccaacacuccaugacacccacacaacaccaccaaccaaaccuaccacuaccagcccaacaaccauuccaaccacaacccguacaaccacaaccacaccaaccauuacaaccccaaucaccaaugcacccaauacaaccacuacucccacaaccaccacuaccaccaauguucucaaugcaaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3735 - RNA, 904 nt, Artificial Sequence
  mRNA product Design2 comprising derived and/or modified sequence from Sus scrofa__J9JIM4__SsAMELX-201 (opt13)
ggggcgcugccuacggagguggcagccaucuccuucucggcaucaagcuuaccaugccacuaccaccacacccaggacacccaggauacauaaacuucucauacgaaguacuaacaccacuaaaaugguaccaaaacaugauaagacaccccuacacaucauacggauacgaaccaaugggaggauggcuacaccaccaaauaauaccaguaguaucacaacaaacaccacaaucacacgcacuacaaccacaccaccacauaccaaugguaccagcccaacaaccaggcauaccacaacaaccaaugaugccacuaccaggacaacacucaaugacaccaacacaacaccaccaaccaaaccuaccacuaccagcacaacaaccauuccaaccacaaccaguacaaccacaaccacaccaaccacuccaaccacaaucacccaugcaccccauacaaccauuacuaccacaaccaccacucccaccaauguucuccaugcaaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3736 - RNA, 3343 nt, Artificial Sequence
  mRNA product Design2 comprising derived and/or modified sequence from Homo sapiens__NP_006120.1__HsBMP1 (opt13)
ggggcgcugccuacggagguggcagccaucuccuucucggcaucaagcuuaccaugccagguguagcacgucuaccauuauugcuagguuuauugcuacuaccccgaccgggacgaccacuagacuuagccgauuacacauaugaccuagcagaagaggacgauagugaaccauuaaacuacaaagauccauguaaagcugccgcauucuuaggugauauagcuuuagacgaagaagauuuacgugcauuucaaguccagcaagcaguagauuuacguagacauacugcacgcaaaaguucaauaaaagcagcuguaccaggaaacacaucaacaccuuccugucaaucaacaaauggucaaccucaaagaggggcuugcggacguuggagggggagaaguagaaguagacgugcagcaacaagucgaccagaacgaguauggccagauggaguaauuccauuuguaauugguggaaacuuuacuggaucacaaagagcuguauucaggcaagcuaugagacauugggaaaaacauacuugcguuacauucuuagaacgaacagaugaagauuccuauauaguauuuacuuauagaccuugugggugcuguaguuauguggguagaagaggggguggaccacaagcaauaucaauugguaaaaauugugacaaauuuggaauaguuguacaugaacuaggacauguaguaggauuuuggcacgaacauacaagaccagauagagacagacauguauccauaguuagagaaaauauacaaccaggacaagaauauaauuuccuaaaaauggagccacaggaaguagagaguuugggagaaacuuacgacuucgacaguauaaugcauuaugcaagaaauacuuuuucacgaggaauauuccuagauacuauugugccuaaauacgaagugaaugguguaaaaccuccaauuggucaaaggacuagguuaagcaaaggagauauagcacaagcgcgcaaacuuuauaaauguccagcauguggugaaacauuacaggacucaacaggaaauuuuucaucaccugaauacccuaacggguauagugcacauaugcacuguguauggagaauaucaguaacaccaggagagaaaauaauauuaaacuucacuagccuggaucuuuauagaucgagacucuguugguaugauuauguagaaguuagagauggcuucuggagaaaagcaccauugagagggcguuuuuguggcaguaaacuaccagaaccaauaguaucuacagauuccagauuaugggucgaguucagaaguucauccaauuggguaggaaaagguuucuucgccguauaugaagcgauaugcggaggggauguaaagaaagacuauggucauauacaaagcccuaauuauccugaugacuauaggccaaguaaaguuuguauuuggagaauacaagugucagaagguuuucacguuggacucacauuucaaucuuuugaaauagagcgccaugacucaugugcguaugacuauuuagagguaagagacggacauucagaaucuucuacucuuauaggaagauauuguggauaugagaaaccagaugauauaaaaaguacaaguucucgacuaugguuaaaauuuguaagcgauggaagcauaaauaaagcaggauuugcaguaaauuucuuuaaagaaguugaugaaugcucgagaccuaauagagggggaugcgaacaacgaugucuaaauacacucggaagcuacaaauguagcugugauccaggauaugaacuugcaccggacaaaagaagaugugaagcugcaugcggcggauuucuaaccaaacucaauggaucaauuacuuccccaggauggccuaaagaauauccaccgaauaaaaacugcauauggcaauuaguagcuccaacacaauaucgcaucagcuuacaauuugacuucuuugaaacugagggaaaugauguuuguaaauaugacuuugucgaagucagaucaggccucacagcagauucuaaauuacacggcaaauuuuguggaagcgaaaaaccggaaguaauaacaucacaauacaauaacaugagaguagaguuuaaaagcgauaauacaguaaguaagaaaggauuuaaagcacacuucuucucagauaaagacgaauguucaaaagacaaugggggaugucaacaagacuguguaaauacguuuggaucauaugaaugucaaugccgaaguggauucguacuucaugauaauaaacaugauuguaaagaagcagguugcgaucacaaaguuacaucaacuucaggcacaauaacuucaccuaacuggccagauaaauauccaucaaagaaagaauguacaugggcaauaucuucaaccccaggucaucgcguaaaauuaacauuuauggaaauggauauugaaucacaaccagaaugugcauaugaucacuuagaaguauucgacggaagggaugcaaaagcaccaguauuagguagauuuuguggcaguaagaaaccagaaccaguucuugcgacaggaagccguauguuuuuaagauuuuacucagauaauuccguacaaagaaaaggauuucaagccucccaugcgacggaauguggaggacaaguacgagcagauguuaaaaccaaagaccuauacucacacgcacaauuuggugauaauaauuacccaggugggguagacugcgaauggguaauaguagcagaagaaggguacggaguugaauuaguauuccaaacauuugaaguagaagaagaaaccgauuguggcuaugauuauauggaacuauucgacggauacgacuccacagcaccgagauuaggacgauacuguggaaguggaccaccagaagaaguuuauucagcaggagacucagucuuagugaaauuucauucggacgacacaauaaccaagaaaggauuccacuuaagauacacuucaacuaaauuccaagauacacuacacaguagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3737 - RNA, 1573 nt, Artificial Sequence
  mRNA product Design2 comprising derived and/or modified sequence from Homo sapiens__NP_001191.1__HsBMP2 (opt13)
ggggcgcugccuacggagguggcagccaucuccuucucggcaucaagcuuaccauggucgccggaaccagaugccuauuagcccuacuauuaccacaaguucuacuagguggagcugcaggauuaguaccagaacuaggaagacgaaaauucgcggcagcauccucaggaagaccaucaucacagccaucagacgaaguacuauccgaauucgaacuaagguuauuaucuauguuuggauuaaaacaaagaccaacgccaucuagagacgcagucguuccaccauacaugcuagaucuauauagaagacacuccggacaaccaggauccccagcacccgaucauagauuagaacgagccgcaucacgugcaaacaccguaagauccuuccaccacgaagaaucucuagaagaacuaccagaaacaucaggaaaaacuacaagaagauucuucuuuaaccuaucaucuaucccaacagaagaauucaucacaucagcagaauuacaagucuuuagagaacaaaugcaagacgcauuaggaaauaacucaucauuucaccacagaauuaacauauacgaaauaaucaaaccagcaaccgcaaacagcaaauucccagucacucgauuacuagauacaagacuaguuaaccaaaacgcaucaagaugggaaucauuugacguaacucccgcaguuaugagauggacagcacaaggacacgcaaaucacggauuugucguugaaguagcccauuuagaagaaaaacaaggaguuucaaaaagacacguccgcauaagcagaucacuacaucaagacgaacauucuuggagucaaauaagaccacuacuuguaacauucggccacgacggaaaaggacacccauuacacaaaagagaaaaaagacaagcaaaacacaaacaaagaaaaagacuaaaaucaucaugcaaaagacauccauuauacguagauuucucagauguaggauggaacgacuggauaguagcaccaccaggauaccacgcauuuuacugccauggagaaugcccauuuccacuagcagaccaccucaacucaaccaaccacgcaauaguucaaacccuaguaaauucaguaaauucaaaaauaccaaaagcaugcugugucccaacagaacuuucugcaauaucaaugcuauauuuagaugaaaacgaaaaaguaguucuaaaaaauuaccaagacauggucguagaaggaugcggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3738 - RNA, 1609 nt, Artificial Sequence
  mRNA product Design2 comprising derived and/or modified sequence from Homo sapiens__NP_001193.2__HsBMP4 (opt13)
ggggcgcugccuacggagguggcagccaucuccuucucggcaucaagcuuaccaugauaccaggaaauagaaugcucaugguaguauuauuaugccaaguacuucuagguggagcuucacaugcaucacuuauaccagaaaccggaaaaaaaaaaguagcagaaauacaaggacaugccggaggaagaagauccggacaaucacaugaauuacuacgagauuuugaggccacuuuauuacagauguucggauuaagaagacgaccucaaccaucaaaaucagcaguaauuccagacuacaugcgagaucuauacagauuacaaucaggagaagaagaagaagaacaaauacacaguaccggacuagaauacccagaaagaccagcaucaagagccaauaccguuagaucauuccaccaugaagaacauuuagaaaauauaccaggaacaucagaaaauucagcuuucagauuuuuauucaauuuaagcagcauaccagaaaacgaagucauaucaucagcagaacuaagacuauuuagagaacaaguugaccaaggaccugacugggaacgcggauuccacagaauaaauauauacgaaguaaugaaaccaccugcugaaguaguaccaggacaccuaauaacuagauuacuagauacaagacuaguacaccauaauguaacaaggugggaaacauuugacguaucaccggcaguauuacgguggacaagagaaaaacaaccaaauuacggacuagcaauagaagucacacacuuacaucaaacaagaacacaucagggucaacacguaagaauaucacgaucacuuccacaagguucagguaacugggcccaauuaagaccauuacuaguaacauuuggacaugacggaagaggacacgccuuaacacgaaggcgaagagccaaaagaaguccaaaacaccauucacaaagagcacgaaaaaaaaacaaaaauugccgaagacauucacuauacguagacuuuucagaugucggauggaaugacuggaucguagcaccaccaggcuaccaagcauuuuacugucacggagauugcccauuuccacuagcagaucacuuaaacucaaccaaucacgcaauaguacaaacacuaguaaauucuguaaacagcucuauaccaaaagcuuguuguguaccaacagaacuaucagccauaucuauguuauaucuagaugaauaugauaaaguaguauuaaaaaacuaucaagaaauggucguagaaggaugcggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3739 - RNA, 1924 nt, Artificial Sequence
  mRNA product Design2 comprising derived and/or modified sequence from Homo sapiens__NP_001709.1__HsBMP6 (opt13)
ggggcgcugccuacggagguggcagccaucuccuucucggcaucaagcuuaccaugcccggauuaggaagacgagcacaauggcuaugcugguggugggguuuauuauguagcuguugcgguccaccaccuuuaagaccaccauuaccagccgcagcugcugcugcagcaggcggucaacuauuaggagaugggggaucacccgggagaacagaacaacccccaccaucaccccaaagcucaucaggguucuuauacagaagauuaaaaacacaagaaaaacgcgaaaugcaaaaagaaauacuaaguguauuaggauugccacauagaccuagaccauuacauggauuacaacaaccacaaccuccagcuuuaagacaacaagaagaacaacaacaacaacaacaauuacccagaggagaaccacccccaggaagacuaaaaucugcuccauuauucaugcuagaccuauacaaugcacuaagcgcagacaaugacgaagauggagcuucugaaggagaaagacaacaaucauggccucaugaagcagcuucaagcagucaaaggagacaaccaccaccaggagcagcacacccacuuaaucgaaaaagccuacuagcacccggcucuggaucaggaggcgcaaguccauuaacaucagcacaagauagcgcguuuuuaaaugacgcagacaugguaaugucauucgugaauuuaguagaauacgauaaagaauuuucuccaagacaaagacaccacaaagaguucaaauucaaucuaucccaaauaccugaaggagaaguaguaacugcagcagaauuuagaaucuacaaagacuguguaaugggaucauucaaaaaucaaacuuucuuaauaucuaucuaccaaguauuacaagaacaucaacauagagacucugauuuauuccucuuagacacaagaguuguaugggcaucagaagaagguuggcuagaauuugacauuacugcaacaucaaacuuauggguaguaacaccacaacauaacaugggacuacaauuaucagucguaaccagagaugguguucauguacacccuagagcugcaggacuuguaggcagagacggaccauacgauaaacaaccauucaugguagcauucuucaaaguaucagaaguacauguaagaacaacacgaucugcuagcucaagaagaagacaacaaagucgcaacagaucuacacaaucacaagauguagcacgaguaucaucugcuucagacuauaacuccuccgaacuaaaaacagcaugcaggaaacacgaauuauacguuuccuuccaagauuuaggauggcaagacuggauaauagcacccaaaggauacgcugcaaacuacugcgacggugaauguucauuuccauuaaaugcacauaugaacgcaacaaaccaugcaaucguacaaacucuaguacaccuaaugaauccagaauauguccccaaaccauguugcgcacccacaaaacuuaacgcaauaucagucuuauacuuugacgacaauucaaauguaauccuaaagaaauauagaaacaugguagucagagccugcgguugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3740 - RNA, 1678 nt, Artificial Sequence
  mRNA product Design2 comprising derived and/or modified sequence from Homo sapiens__NP_001710.1__HsBMP7 (opt13)
ggggcgcugccuacggagguggcagccaucuccuucucggcaucaagcuuaccaugcauguaagaucacuaagagcagcugccccacacucauuuguagcacugugggcaccacuuuuuuuacuaagaagcgcauuagcagacuuuucacuagacaaugaaguacauucaagcuuuauucauaggagacuucggucacaagaaagacgugaaaugcaaagagaaauauuaucuauucuaggacuaccacaccgcccaagaccacaucuacaaggaaaacacaauucagcuccaauguucaugcuagaucuuuauaacgcaauggcagucgaagaaggaggaggccccggaggacaaggauuuuccuauccauauaaagcaguauuuucaacacaaggaccuccucuagcaagucuacaagauucacauuucuuaacagaugcagauaugguaaugucauuuguaaauuuaguagaacaugauaaagaauuuuuucacccacguuaccaccauagagaauucagauucgaucuaucuaaaauaccagaaggugaagcaguaacagcagcugaauucagaauauacaaagauuacauacgagaaagauuugacaacgaaacauucagaauaucaguauaucaaguacuacaagaacacuuagguagagaaagcgaucuauuucuauuagacuccagaacacucugggcaucagaagaaggcuggcuaguauucgauauaacagcaaccaguaaucacugggucguaaacccaagacacaaccucggacuacaauuaucaguagaaacauuagacggccaaaguauuaacccaaaacucgcaggacuaauaggaagacacggaccacaaaacaaacaaccauucaugguagcauucuuuaaagcaaccgaaguacacuucagaucaauacgaucaacaggauccaaacaaagaagccaaaauagaucaaaaacuccaaaaaaucaagaagcauuaagaauggcaaauguagcugaaaauucaucaagugaucaaagacaagccugcaaaaaacacgaauuauacguauccuuccgagauuuaggauggcaagacuggauaauagcaccugaaggcuacgccgcauacuacugugaaggagaaugugcauuucccuuaaacucauauaugaacgcaacuaaucacgcuauaguacaaacacuaguacacuuuauaaaucccgaaacaguacccaaaccaugcugcgcaccaacacaacucaacgcuauaucaguauuauauuuugacgacucuucuaacguuauccuaaaaaaauaucgaaauaugguagucagagcauguggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3741 - RNA, 682 nt, Artificial Sequence; identical to SEQ ID NO: 3189
  mRNA product Design2 comprising derived and/or modified sequence from Homo sapiens__NP_006264.2__HsCCL7 (opt13)

SEQ ID NO: 3742 - RNA, 4006 nt, Artificial Sequence
  mRNA product Design2 comprising derived and/or modified sequence from Homo sapiens__NP_001954.2__HsEGF (opt13)
ggggcgcugccuacggagguggcagccaucuccuucucggcaucaagcuuaccauguugcuuacuuuaauaauauuacuuccaguugucaguaaauuuucguuugugucauuaucugcaccacaacauuggaguuguccagaagguacgcuagcaggcaacgguaauucuacgugugucgguccagcgccauuucuaaucuuuucucaugguaacuccauuuuuagaauagauacagaagguacaaauuacgaacaauuaguaguugacgcaggagucagcguaauaauggacuuucauuauaaugagaaaagaaucuauuggguagacuuggaaagacaauuacuucagcguguauucuugaauggauccagacaagaaagaguauguaauauagagaaaaauguaucagguauggcuauaaacuggauaaaugaagaagugauuuggucaaaucaacaagaagggaucauuaccguuacagacaugaaaggaaauaauucccacauacuacuaucagcacuaaaauaucccgccaauguugcaguagauccaguggaaagauuuauauuuugguccucagaaguagcaggaucauuauauagagcagacuuagacgguguggguguuaaggcuuuacuagaaacuucugagaaaauuaccgcaguaaguuuagacguuuuagacaaaagauuauuuuggauucaauauaauagggaagguucaaauucacuuauauguucuugcgacuaugaugguggaucagugcauauaaguaaacauccaacgcaacacaaucucuuugcaaugucuuuauuuggugauagaauauuuuacagcacuuggaaaaugaaaacaauauggauagccaacaaacauaccggaaaagauaugguaaggauaaaucuacacaguuccuucguuccuuuaggugaacuaaaaguaguacauccacuagcgcaaccuaaagcggaagaugacacuugggaaccagaacaaaaacuauguaaguuacgaaaaggcaacuguucaucuacagugugcgggcaagacuuacaaagucacuuauguaugugcgcggaaggcuaugcgcucaguagagauagaaaauauugugaagauguaaaugaaugugcauuuuggaaccauggauguacacuaggaugcaaaaauacaccagguucauauuauuguacuugucccguuggauuuguccuguuaccagacggcaaaaggugccaucagcuaguaaguuguccacguaauguuucagaauguagccacgauuguguuuugacaagugaaggaccacuaugcuuuugcccagaaggaucaguauuagaaagggauggaaaaacauguagugguuguaguucaccagauaauggagguuguagucaacuuuguguuccauuaucuccuguaucuugggaaugcgauuguuucccagguuaugauuuacaauuagaugagaaaaguugugcagcgucuggcccacaaccauucuuacucuuugcaaauucacaagauauaagacacaugcauuucgauggcaccgacuacggcacccuauuaagucaacaaauggggaugguauaugcacuugaccaugauccaguagaaaacaaaauauacuucgcacauaccgcacucaaauggaucgaaagagcaaauauggacggaagucaaagggaacgguugauugaagaaggaguagauguaccugaggguuuagcaguugauuggauagggaggagauuuuauuggacggacagggggaaaaguuuaauaggacgaagcgaccucaacgggaaaagaagcaaaauaaucacuaaagaaaauauuucacaaccaagaggaauugcuguacauccaauggcaaaacgucuauuuuggacagacacaggaauaaauccuagaauagaguccaguucacugcaaggauuggggagauuagugaucgccaguuccgaccuaauauggccaucgggaauuacaauagacuuuuuaaccgauaaacuauauuggugcgaugcaaaacagucaguaauugaaauggccaaucuagauggaucuaaaagaagaagacuaacacaaaaugaugugggacacccauuugcuguugccguuuucgaggacuacgucugguuuucagauugggcaaugccaagugucaugagagucaauaagagaacugguaaggauagagucagauuacaaggcucaauguuaaaaccaucgagucuagucguaguccacccauuagcaaaaccaggugcagaucccugcuuauaucaaaauggagggugcgaacacauauguaagaaaagacuuggcacagcaugguguucauguagagaaggauuuaugaaggcuucagauggaaaaaccuguuuagcauuagauggccaucaacuucucgccggaggagaaguugacuugaaaaaccaaguaacaccccuagauauauuaagcaaaacaagaguuagcgaagauaacauaacagaaucucaacauauguuaguagcagaaauuauggucucagaucaagaugacugcgcaccuguaggauguucuauguaugcuagaugcauaucagagggggaagaugcgacaugucaaugcuuaaaaggauuugcaggcgacggaaaauuaugcucagacauagacgaaugugaaaugggaguuccuguuuguccuccagcaucuuccaaauguauaaauaccgaaggugguuauguauguagauguagugaaggauaccaaggggacgguauccauuguuuagauauagaugaaugccaauugggagaacacuccuguggagagaacgcauccuguacaaauacugaaggagguuauacguguaugugcgcaggaaggcuuuccgaaccugguuuaauuugcccagauucaacaccucccccacaccuucgugaagaugaccaccauuauaguguacgaaauucagauucugagugcccacuaagccaugauggauauuguuuacacgauggaguaugcauguacauagaagcguuggauaaauacgcuuguaauugugugguuggauacauaggugaaagaugucaauaccgagaccuaaaauggugggaacuaagacaugccgggcacggacaacaacaaaaaguaauagucguugcaguguguguaguagucuuagucaugcuauuacuauugagccucuggggugcacacuauuauaggacacaaaaacuacuaucuaaaaaccccaaaaauccauaugaagaaucaagucgugaugucagaucaagaagaccagcagacacagaagacggaaugucaucguguccacaaccaugguuugugguaauuaaagaacaucaagaucucaaaaacggaggccaacccguugcuggugaagauggacaagcagcagaugguaguaugcagcccacaucauggcgacaagagccacaauuaugcggcaugggaacagaacaagguuguuggauuccaguuaguucugacaaaggaagcuguccgcaagugauggagaggucauuucauaugccaagcuacggaacacagacacucgaaggcggaguagagaaaccacauucgcuucuuucugcaaacccauuauggcaacaaagagcucuagauccaccucaccaaauggaauugacucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3743 - RNA, 892 nt, Artificial Sequence
  mRNA product Design2 comprising derived and/or modified sequence from Homo sapiens__NP_001423.1__HsEREG (opt13)
ggggcgcugccuacggagguggcagccaucuccuucucggcaucaagcuuaccaugacagcaggcagaagaauggaaaugcuaugugcaggacgaguaccagcauuauuacuaugucuaggauuccauuuauuacaagcaguacuaagcacaacaguaauaccaagcuguauaccaggagaaagcucagacaauugcacagccuuaguacaaacagaagacaauccaagaguagcacaaguaaguauaacaaaaugcucaagcgauaugaauggauauugcuuacacggacaauguauauaucuaguagacaugagccaaaacuauugcagaugcgaagucggauacacaggaguaagaugugaacauuucuucuuaacaguacaucaaccacuaucaaaagaauacguagcauuaacaguaauauuaauaauacuauuucuaauaacaguaguaggaagcacauacuauuucuguagaugguacagaaacagaaaaucgaaagaaccaaaaaaagaauacgaacgaguaacaucaggagauccagaacuaccacaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3744 - RNA, 850 nt, Artificial Sequence
  mRNA product Design2 comprising derived and/or modified sequence from Homo sapiens__NP_000791.1__HsFGF1 (opt13)
ggggcgcugccuacggagguggcagccaucuccuucucggcaucaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggcacaguagacggaacaagagacagauccgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaagcugcaaaagaggaccaagaacacacuacggacaaaaagccauacuauuccuaccacuaccaguaucaucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3745 - RNA, 1249 nt, Artificial Sequence
  mRNA product Design2 comprising derived and/or modified sequence from Homo sapiens__NP_001997.5__HsFGF2 (opt13)
ggggcgcugccuacggagguggcagccaucuccuucucggcaucaagcuuaccaugguaggaguaggagggggagauguagaagauguaacaccaagaccagguggaugucaaauuagcggaagaggugcaagaggauguaauggaauaccaggagcagcagcuugggaagcagcauuaccgagaagacgaccgagaagacauccgagugugaauccaagaucaagagcagcuggaagcccaagaacaagaggaagaagaacagaagaaagaccaaguggaagcagauuaggagauagaggaagaggacgagcauuaccaggaggaagauuaggaggaagaggaagaggaagagcaccagagagaguaggagggagaggaagaggaagaggaacagcagcgccaagagcagcaccagcagcaagaggaucaagaccaggaccagcaggaacaauggcagcgggaaguauaacaacauuaccagcucuaccagaagauggaggaaguggggcguuuccaccaggacauuuuaaagauccaaaaagauuauauuguaaaaauggaggauuuuuuuuaagaauacauccagauggaagaguagaugggguaagagaaaaaucagauccacauauaaaauuacaauuacaagcggaagaaagaggagugguaaguauuaaaggaguuugugcaaauagauauuuggcgaugaaagaagaugggagguuauuagcaaguaaauguguaacggaugaauguuuuuuuuuugaaagacuagaaagcaauaacuauaacacauauagaucgagaaaauacacaucaugguauguagcauuaaaaagaacaggacaauauaaacuaggaaguaaaacaggaccaggacaaaaagcaauauuauuuuuaccaaugagugcaaagaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3746 - RNA, 967 nt, Artificial Sequence
  mRNA product Design2 comprising derived and/or modified sequence from Homo sapiens__NP_002000.1__HsFGF7 (opt13)
ggggcgcugccuacggagguggcagccaucuccuucucggcaucaagcuuaccaugcacaaauggauacuaacauggauacuaccaacacuacuauacagaagcugcuuccacauaauaugccuaguaggaacaauaucacuagcaugcaacgacaugacaccagaacaaauggcaacaaacguaaacugcucaucuccagaaagacacacaagaucauacgacuacauggaaggaggagacauaagaguaagaagacuauucugcagaacacaaugguaccuaagaauagacaaaagaggaaaaguaaaaggaacacaagaaaugaaaaacaacuacaacauaauggaaauaagaacaguagcaguaggaauaguagcaaucaaaggaguagaaucagaauucuaccuagcaaugaacaaagaaggcaaacuauacgcaaaaaaagaaugcaacgaagacugcaacuucaaagaacuaauacuagaaaaccacuacaacacauaugcaagcgcaaaauggacacacaacggaggagaaauguucguagcauuaaaccaaaaaggaauaccaguaagaggaaaaaaaacaaaaaaagaacaaaaaacagcacacuuccuaccaauggcaauaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3747 - RNA, 1009 nt, Artificial Sequence
  mRNA product Design2 comprising derived and/or modified sequence from Homo sapiens__NP_001936.1__HsHBEGF (opt13)
ggggcgcugccuacggagguggcagccaucuccuucucggcaucaagcuuaccaugaaauuauuaccaucaguaguacuaaaacuauuucuagcagcaguacuaucagcauuaguaacaggagaaagccuagaaagacuaagaagaggacuagcagcaggaaccucaaacccagacccaccaacaguaucaacagaucaauuacuaccacuaggcggaggaagagauagaaaaguaagagacuuacaagaagcagaccuagauuuacuaagaguaacauuaucaucaaaaccacaagcacuagcaacaccaaacaaagaagaacacggaaaaagaaaaaaaaaaggaaaaggauuaggaaaaaaacgagauccaugccuaagaaaauauaaagacuucugcauacauggagaaugcaaauacgucaaagaacucagagcaccaagcugcauaugucacccuggauaccacggagaaagaugccacggacuaagucuuccaguagaaaacagauuauacacauacgaccacacaacaauacuagcaguaguagcaguaguauuaagcucaguaugucuauuaguaauaguaggucuacuaauguucagauaucaccgaagaggaggauacgauguagaaaaugaagaaaaaguaaaacuaggaaugacaaauagccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3748 - RNA, 2569 nt, Artificial Sequence
  mRNA product Design2 comprising derived and/or modified sequence from Homo sapiens__NP_000592.3__HsHGF (opt13)
ggggcgcugccuacggagguggcagccaucuccuucucggcaucaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3749 - RNA, 2308 nt, Artificial Sequence
  mRNA product Design2 comprising derived and/or modified sequence from Homo sapiens__NP_005336.3 __HsHSPA1A (opt13)
ggggcgcugccuacggagguggcagccaucuccuucucggcaucaagcuuaccauggccaaagcagcugcaauaggaauagaucuaggaacaacauacuccuguguaggaguauuccaacacggaaaaguagaaauaaucgcaaaugaucaagguaacagaacaacaccaucauacguugcauuuacagacacagaaagauuaauaggagaugcagccaaaaaccaagucgcacuaaauccacaaaacacaguauuugaugcaaaacgcuuaauaggaagaaaauuuggcgauccaguaguacaaucagacaugaaacauuggccauuucagguaauaaacgauggagauaaaccaaaaguucaaguuaguuacaaaggcgaaacuaaagcauuuuacccggaagagauaucaagcaugguauuaacaaaaaugaaagaaaucgcagaggcuuauuuaggauacccaguaacaaacgcaguaauaacaguaccagcuuacuuuaaugauagucagagacaagcaacuaaagaugccggaguaauugccggacuaaacguacuaagaauaauaaacgaaccaacugcagcagcaauagcauauggauuagauagaacaggcaaaggagaaagaaauguauuaauauucgaccuaggaggagguacauucgacgugucaauauuaacaauugaugauggaauauucgaaguaaaagcaacagccggggacacacauuuagggggagaagauuuugacaacagacugguaaaccauuuuguagaagaauuuaaaagaaaacacaagaaagacauuucacaaaauaaaagggcaguuagaagacuaagaacugcaugugagagggcaaaaaggacguuaagcaguaguacccaagcaucacuagagauagacucauuauuugaaggaauugauuuuuauacuucaaucacgagagcgagauuugaagaauuauguagugaucucuuuagaucgacauuagaaccugucgaaaaagcacuaagagaugcgaaacuagacaaagcacaaauacaugacuuaguucuaguaggaggaucaaccagaauaccaaaaguacaaaaacuacuacaagauuucuucaacggaagggacuuaaauaaaucaauaaacccagaugaagcugucgcuuacggugcagcuguccaagcagcaauacuaaugggagauaaaagcgagaaugugcaagacuuauuauuauuagacguugcaccucuaucgcuaggacuagaaacagcaggaggaguaaugacagcacuuauaaaaagaaacagcacaauaccgacuaaacaaacgcaaauauuuacaaccuauucagauaaccaaccuggcguccuuauacagguuuaugaaggugaaagagcaaugacaaaagauaacaaucuacuaggaagauuugagcuaaguggaauaccaccagcaccucgaggaguaccacaaauagaaguuacauucgacauagacgcuaauggcauucuaaaugugacagcuacugacaaaaguaccggaaaagcaaauaaaauaacuauuacaaacgauaaaggaagacuaagcaaggaagagauagaacgcaugguacaggaagcagaaaaauacaaagcggaagacgagguccagcgagaaagaguaagcgcuaaaaacgcauuagaaucauaugcauucaacaugaaaagcgcaguagaagaugaaggacuaaaagguaaaauaagcgaagcagauaaaaagaaaguacuagauaaaugucaagaaguuauaaguugguuagaugcaaauacuuuagcggaaaaagaugaauuugaacauaaaagaaaagaacuagaacagguaugcaauccuauuauaucaggauuauaccaaggagcuggaggaccaggaccaggaggcuucggagcacaaggaccgaaaggaggauccggaucagggccaacaauagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3750 - RNA, 2308 nt, Artificial Sequence
  mRNA product Design2 comprising derived and/or modified sequence from Homo sapiens__NP_005337.2 __HsHSPA1B (opt13)
ggggcgcugccuacggagguggcagccaucuccuucucggcaucaagcuuaccauggcaaaagcugcagcaauaggaauagaccuaggaacaacauacuccugcguaggaguauuucagcaugguaaaguugaaauaauagcuaacgaccaaggcaacagaacaacccccucauacgucgcauucacagauaccgaaagauuaaucggagaugcggcuaaaaaccaaguggcacucaauccacaaaacacaguauuugacgcaaaaagacugauaggaagaaaauucggcgauccagugguucaaucagauaugaaacauuggccauuccagguaauaaaugauggagauaaaccaaaaguacaaguaucauauaaaggagaaacaaaagcauuuuauccagaggaaauaaguaguaugguauuaacaaaaaugaaagaaauagcugaagcauaucucggauacccaguaacaaacgccguaauaacaguuccagcauauuucaacgacagucaaagacaagcaacaaaagaugcaggaguaauagcuggccuaaauguacuuagaauaauaaaugaaccuacugcugcugccauagcauacggacuagaucgaacaggcaaaggagaaagaaauguuuuaauauucgaccuuggaggaggaacauucgacguaagcauuuuaacaauagaugauggaauauuugaaguuaaagccacugcaggggauacucaccuaggaggagaagauuucgauaacaggcuaguuaaucauuuuguagaagaauuuaaaagaaaacauaagaaagacauaagucaaaacaaaagagcaguaagaagauugagaacagcaugugaaagagcuaaaagaacgcuaagcucaagcacacaagcaaguuuagaaauagauaguuuauuugaaggaauagauuuuuauacuucgauaacgagagcaagauuugaagaauuauguucagauuuauuuagaucaacguuagaaccaguugaaaaagcacuaagagacgcaaaauuagauaaagcucaaauacaugaccuagucuuggucggaggcucaacacgaaucccuaaaguacaaaaauuacuucaagauuucuuuaacgguagagaucuaaauaaaucaauaaaucccgacgaagcuguagcauauggagcagcuguacaagccgcaauucuuaugggagauaaaucagaaaauguacaagauuugcuacuuuuagacguggcaccacuuagccuaggacuagaaacagcuggaggaguaaugaccgcauuaauaaaacgcaacucgacuauaccaacaaaacaaacacaaaucuuuacaacauacagugauaaucaaccaggaguacuaauacaaguauaugaaggagaaagagcaaugacuaaagacaauaaucuacuaggacgguucgaacuaagcggcauuccaccagcaccucgaggaguaccacaaauugaaguaacauuugauauagacgcaaacgggauauuaaacguuacagcaaccgauaaaagcacaggcaaagcaaacaaaauaacaauuacaaaugauaaaggaagacuuucaaaagaagaaauagagagaaugguacaagaagcugagaaauacaaagccgaagacgaaguccaaagagaaagaguuagcgcuaaaaacgcacuggaaucauaugcuuucaauaugaaaucagcaguagaggacgaaggacuaaaaggcaaaauuucagaagcagacaaaaagaaaguacuagauaaaugucaagaaguaauuagcugguuagaugcaaauacccuggcagagaaagaugaauuugaacauaaaagaaaagaauuagaacaaguaugcaaucccauaauaucaggucuguaucaaggagcaggcgggccaggaccaggaggauuuggagcacagggaccaaaagguggauccgguagcggcccaacaaucgaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3751 - RNA, 2308 nt, Artificial Sequence
  mRNA product Design2 comprising derived and/or modified sequence from Homo sapiens__NP_005518.3 __HsHSPA1L (opt13)
ggggcgcugccuacggagguggcagccaucuccuucucggcaucaagcuuaccauggcaacagcaaaaggaauagcaauaggaauagacuuagggacaacuuacaguuguguuggaguauuucagcacgggaaagucgaaauaauagcaaacgaucaagguaauaggaccaccccuucguacguagcauuuacagauacugaaagacuaauaggugaugcagcgaaaaaccaagucgcaaugaacccgcaaaauacaguauuugacgcaaaacgguuaauuggaagaaaguuuaacgacccaguuguacaagcagauaugaaauuauggccauuccaaguaauaaacgaaggaggaaaaccuaaaguguugguauccuauaaaggcgaaaacaaagcauuuuauccggaagaaauaucaucaaugguacuaacaaaacuuaaagaaacggcagaagcauuucuaggacauccagucacaaacgcaguaauaacaguuccagcauacuuuaacgauagucaaagacaagcaacgaaagaugcaggaguuauagcaggucuaaauguacuuaggauaaucaacgaaccaacggcagcagcaauagcauacggacuagauaaaggaggacaaggagaaagacauguacuaauauuugauuuaggcggaggaacauucgacguaaguauauuaaccauagaugauggaauauucgaaguaaaagcaacagcaggggacacacacuuaggaggcgaagacuucgauaacaggcuaguaagccauuuuguagaagaguucaaaagaaaacacaagaaagauauaucacaaaauaaacgcgcaguacgaagacucagaacagcuugcgaaagggcaaaaagaaccuuaagcucuaguacacaagcaaaccuggaaaucgauaguuuauacgaaggaauagauuucuauacaucaaucacuagagcuagauuugaagaacucugugcagaucuauuuagaggaacauuagaacccguagaaaaagcgcuuagagacgccaaaauggacaaagcaaaaauacaugacauaguccuaguagguggaaguacgcguauaccaaaaguacaaagauuauuacaggauuauuucaacggaagagaucuuaacaaaaguauaaaucccgaugaagcaguagcauacggugcagcaguacaggcagcaauacuaaugggagauaaaucugaaaaaguacaagacuuacuacuguuagacguagcaccacuuucacuaggacuagaaacagcuggagguguaaugacagcauuaauaaaaagaaauucaacuauaccaacuaaacaaacacaaauauuuacaaccuauagugacaaucaaccaggaguacuaauacaaguauaugaaggagaaagagcaaugacaaaagauaacaaucugcuaggaagauuugaucuaacgggaauaccaccagcaccaagaggaguaccacaaauagaaguaacguuugacauugaugcaaauggaauacuaaacgugaccgccacagauaaaaguacuggaaaagucaauaaaauaacuaucacaaacgauaaagggagacuaagcaaagaagagauagaaagaaugguuuuagaugcagaaaaauacaaagcagaagacgagguacaaagagagaaaauagcagcuaaaaaugcauuagaaucauaugcauuuaauaugaaaagcguaguaucagacgaaggauuaaaaggaaaaauaagcgaaagugauaaaaacaaaauacuagacaaaugcaaugaacuauuaucaugguuagaaguaaaucagcuagcagaaaaagaugaauuugaccauaaaagaaaggaacuagaacaaauguguaauccaauaauaacaaaauuauaccaaggggguugcacaggaccugcauguggaacaggauaugucccaggcagaccagcaacaggaccaacgaucgaagaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3752 - RNA, 2302 nt, Artificial Sequence
  mRNA product Design2 comprising derived and/or modified sequence from Homo sapiens__NP_068814.2 __HsHSPA2 (opt13)
ggggcgcugccuacggagguggcagccaucuccuucucggcaucaagcuuaccaugucagcacgugggcccgcgauagguauagaucuagggacaacauacagcugcguugggguguuucaacacggaaaaguagaaauaauagcaaaugaucaagguaacagaaccacaccaaguuacguugcauuuacagauacugaaagguuaauaggagacgcagcgaaaaaccaaguagccaugaacccaacaaauacgaucuuugacgcaaaacgucuuauaggacguaaauuugaggacgcgaccguccaaagcgauaugaaacacuggccauuuagaguaguaagcgaaggaggaaaacccaagguacaaguagaauacaaaggagaaacaaaaaccuuuuucccugaagaaauaucaucaaugguauuaacaaaaaugaaagaaauagcagaagccuaccuugggggaaaaguccacucagcaguaauaacgguaccagcauacuuuaacgauagccagagacaagccacaaaagaugcagggacaauaacaggacucaauguauuaagaauaauuaaugagccuacagcagcagcaauagcauauggauuagauaagaaaggaugugcggguggggaaaagaacguauuaauauuugaccuagguggaggaacauucgacguaaguauacuaacaauagaagauggaaucuucgaagugaaaaguacagcaggagauacucaccugggcggagaagauuuugauaaucgaaugguuucacauuuagcagaagaguucaaacgaaagcacaagaaagauauaggaccaaacaaaagagcaguacgaagauugcgaacagcgugcgaaagagcgaaaagaacacugaguucaucaacacaagcgagcauagaaauagacucacuuuaugaaggaguagauuuuuauacaaguauaacacgcgcaagauuugaagaguuaaaugcagauuuauucagaggaacguuagaaccgguugagaaagcacuaagagacgcaaaacuugacaaaggccaaauacaagaaauaguauuagucggcggaucaacuagaauaccaaaaauacaaaaacuacugcaagacuucuuuaauggaaaagaacucaacaaaagcauaaauccagacgaagcagucgcauauggugcagcaguacaagcagcaauauuaauaggggauaaaucagaaaacgugcaagaucuacuguuacuagaugucacaccacuaucacuagguauagaaacagcaggggguguaaugacaccucuaauaaaaagaaauacaaccauuccaacaaaacaaacacaaacauuuacaaccuacucagauaaucaaucaagcguucuaguacaaguauaugaaggugaaagagcaaugacgaaggauaauaauuuauuaggaaaauucgaucucacagguauaccaccagcgccccgaggaguaccacaaauugaaguaacuuuugacauagaugcaaacggaaucuuaaauguuacagcagcagauaaaagcaccggaaaagaaaauaaaaucacuauaacgaaugauaaaggaagauuaagcaaagaugauauagauagaaugguacaagaagcggaaagauacaaaagugaagacgaagcaaauagagauagaguggcagccaaaaaugcacuagaaagcuauacauauaauaucaaacaaacagucgaagaugaaaaacuaagaggaaagauaucagaacaagauaaaaacaaaauauuggacaaaugucaagagguaauaaacugguuagauagaaaucaaauggcugaaaaggaugaauaugaacauaaacaaaaagaauuagaaagaguaugcaauccuauaauaucaaaacuauaucaaggaggaccaggaggaggaagcggaggaggaggaagcggcgcaucagguggaccaaccauagaggaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3753 - RNA, 2905 nt, Artificial Sequence
  mRNA product Design2 comprising derived and/or modified sequence from Homo sapiens__NP_002145.3 __HsHSPA4 (opt13)
ggggcgcugccuacggagguggcagccaucuccuucucggcaucaagcuuaccaugaguguuguugguauugauuuaggcuuccaaagcugcuauguggcaguugcacgagcgggaggcauagaaacaauagcaaaugaauacagcgaucgaugcacccccgcauguaucucauucggaccuaaaaacagaucaaucggagcagcggcaaaaucacaaguaauuucaaaugcgaaaaacacuguacagggauucaaaagauuucauggaagggcauucagugacccauuuguagaagcugaaaagaguaacuuggcuuaugauauagugcaacuaccaaccggcuuaacaggaauaaaaguaacauacauggaagaagaaagaaacuuuacaacagaacaaguuaccgcaauguuacuuaguaaauuaaaagaaacugcagaaagcguguuaaagaaaccaguaguagauuguguugugaguguacccugcuuuuacacagaugcggaaaggagaucuguaauggacgcuacacaaauagcgggacuaaacugcuuaagacuaaugaaugaaacaacagcagucgcauuagccuacggcauuuauaaacaagacuuacccgcauuagaagaaaaaccaagaaacguaguuuuuguggacaugggacacucagcauaucaaguaucagugugugcauuuaauagaggcaaacuaaaaguauuagcaacagcauuugacaccacacuaggaggaaggaaauucgaugaaguacuuguaaaccauuucugugaagaguucggcaagaaauauaaacuagauauaaaaucaaaaauaagagccuuauuacgacuuucacaagaaugugaaaaauuaaagaaacugaugucagcaaaugccuccgaucugccacuaaguauagaaugcuucaugaaugauguagaugucucaggaacgaugaaccgcgguaaauuuuuagaaaugugcaaugaucuauuggcaaggguagaaccaccgcuuagaagcguccuagaacaaaccaaacuaaagaaagaagauauauaugcuguagaaauugucggaggagcaacaagaaucccagcaguaaaagagaaaauaaguaaauucuuuggaaaagaauuaucaacaacgcuaaaugcagacgaagccguaacacgaggaugcgcauuacagugugccauacuaaguccagcauucaaaguaagagaguucaguauaaccgacguuguaccauacccuauaaguuuaagguggaauagucccgcagaagaagguagcucagauugugaaguauuuucuaaaaaucacgcagcaccauuuucaaaaguauuaacauucuacagaaaagagccuuuuacacuagaggcuuauuauucaucaccccaagaccuaccauacccugauccagcuauagcacaauucagcguacaaaaagugacaccacaaagcgaugggaguagcucaaaaguaaaaguaaaaguaagagucaacguacauggaauauuuucaguaaguagugcaagccuaguagaaguacauaaaucagaagaaaaugaagaaccuauggaaacagaucaaaacgcgaaagaagaagagaaaaugcaaguugaucaagaagaaccccaugucgaagaacaacaacaacaaacaccagcugaaaauaaagcagaaagcgaggaaauggaaaccagccaagcuggauccaaagacaagaaaauggaucaaccaccccaagcaaagaaagcaaaaguaaaaacuagcacagucgacuuaccaauagaaaaccaacuccuauggcagaucgacagggaaaugcuaaaucucuauauagaaaaugagggaaaaaugauaaugcaggacaaacuagaaaaagagaggaacgacgcuaaaaacgcaguagaagaauacguauacgaaaugagagauaaacuaucaggggaauaugaaaaauuuguaucugaagaugauagaaacaguuuuacauuaaaauuggaagauacugaaaacugguuauacgaagauggcgaagaccaaccaaaacaaguauacgucgacaaacuagcugaacuaaagaaucuaggucaaccaauaaaaauaagauuccaagaaucagaagaaagaccaaaauuauucgaagaacuaggaaaacaaauacaacaauauaugaaaauaaucucaucauuuaaaaauaaagaagaccaauacgaccaucuagaugcagcagauaugacaaaaguagaaaaaucuacuaacgaagcaauggaauggaugaauaauaaauuaaaccuccaaaauaaacaaucacugacgauggaucccguuguuaaaagcaaagaaauagaggcaaaaauaaaagaacuaacaagcacguguagucccauaauaucaaaaccaaaaccaaaaguagaacccccaaaagaagaacagaaaaaugccgaacaaaaugguccaguagauggacaaggagacaauccaggcccacaagcagcagaacaaggaacagauacagccgugccaucagauagugacaagaaauuaccagaaauggauauugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3754 - RNA, 2902 nt, Artificial Sequence
  mRNA product Design2 comprising derived and/or modified sequence from Homo sapiens__NP_055093.2 __HsHSPA4L (opt13)
ggggcgcugccuacggagguggcagccaucuccuucucggcaucaagcuuaccaugagcguuguuggcauagaucucggauuccuaaacugcuauauagccguagcuagaagcgguggaauagaaacaauagcgaacgaauacucggaccgcugcacaccagcuuguaucagcuuaggaucccgcaccagagcaauaggcaaugcagcgaaaagccaaauagugacaaacguacgaaauacuauacauggauuuaaaaaacuacacggaaggaguuucgaugacccuauaguacaaacggaaagaauacgacucccauaugaacuacaaaagaugccgaauggaagugcaggaguaaaaguaagauaccucgaagaagaaagacccuuugcaauugaacaaguaacuggaauguuacuagcaaaauuaaaagaaacaucggaaaacgcauuaaaaaaaccgguugccgacugcguaauauccaucccaaguuuuuuuacggaugcagaaagaagaaguguaauggcggcagcacaaguagcaggauuaaauugccuaaggcucaugaacgaaacgacagcaguagcuuuagcauacggaauuuauaaacaagauuugccaccauuagaugagaaacccagaaauguaguauucauagacaugggacacucugccuaucaaguacucguuugugcauucaauaaaggcaaauuaaaaguuuuagccacaacauucgaucccuaccucggcggaaggaauuucgacgaagcauuaguagauuauuuuugcgaugaauucaaaacaaaauacaaaauaaaugugaaagaaaacuccagagcauuacucagacuauaccaagaaugugaaaaacuaaaaaaacuaaugagcgcaaaugcaagcgaccucccccuaaacauagaaugcuuuaugaaugacuuggacguaucuucaaaaaugaacagagcccaauucgagcaauuaugcgcgucauuacuagcccgaguagaaccuccacuuaaagcaguaauggaacaagcaaacuuacaacgagaagauauaucaucuauagagauuguaggaggagcaacaagaauccccgcaguaaaagaacagaucacuaaguuuuuuuuaaaagacauuucuacaacacucaaugccgaugaagccguugcacgaggaugugcauuacaaugcgccauauuauccccagcauuuaagguaagagaauucagcauuacagaccugguuccauauucaauaacauuaagauggaaaacaaguuuugaagacggaucaggugaaugcgaaguauucugcaaaaaccauccagcaccauucucuaaaguaauuacauuccauaaaaaagaaccauuugaacuagaagcuuuuuauacuaaccuacacgaaguaccauacccagaugcaaggaucgguucauuuacaauacaaaacguguucccgcaaagcgacggagacucuaguaaagugaaaguuaaaguaagagucaauauacauggaauauuuucagucgccucagccucagugauagaaaaacagaacuuagaaggagaccauagugacgcuccuauggaaacugaaacauccuucaaaaaugaaaauaaagacaauauggauaaaaugcaaguagaccaggaagaaggacaucagaaaugccaugccgaacauacuccugaggaagaaauagaucauacaggagcaaaaacaaaaucggcaguaucagauaaacaagacagauuaaaucaaacucuaaaaaaagggaaaguuaaaucaauagacuuaccaauacaaucgagcuuaugcagacaguuaggacaagaccuacuuaacucauauauugaaaaugaaggcaaaaugauuaugcaagacaaauuagaaaaggagaggaacgaugccaaaaacgcagucgaagaauacguauaugacuucagagauagacuaggaacuguauaugaaaaauuuauuaccccagaagacuuaucgaaacuaagcgccguucuagaagauacagaaaacuggcuguaugaggauggagaagaucaacccaaacaaguauacguugacaaacuacaagaauugaaaaaauacggacaaccaauccaaaugaaauacauggaacacgaagaaagaccaaaagcauuaaaugaucucggaaaaaaaauccaauuaguaaugaaaguaauagaagccuaucguaauaaagaugaaagauacgaucaucuagacccuacagaaauggaaaaaguagaaaaauguauaucagaugcaaugaguugguuaaauucaaaaaugaacgcacaaaauaaacuaaguuuaacgcaagacccuguaguaaaagucucugaaaucguagcaaaaagcaaagaacuggacaacuucugcaaccccauaauauacaaacccaaaccuaaagcagaggugccagaagacaaacccaaagcaaauucugaacauaacgguccaauggacggacaaagcggaacagaaacaaaaucagacucaacaaaagauaguucacaacauacaaagucaucuggcgaaauggaaguugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3755 - RNA, 2347 nt, Artificial Sequence
  mRNA product Design2 comprising derived and/or modified sequence from Homo sapiens__NP_005338.1__HsHSPA5 (opt13)
ggggcgcugccuacggagguggcagccaucuccuucucggcaucaagcuuaccaugaaauuaucuuuaguagcggcaaugcuauuacuacuaagcgcagcaagggcagaggaagaagauaaaaaagaagacgucggaacaguagucgguauagaccuaggaaccacauauucaugcgucggaguuuuuaaaaacggaagaguugaaaucauagcaaacgaucaaggaaacagaaucacaccaucauacguagcguucacaccugaaggagaacgacucauaggagaugcagcaaaaaaucaauuaacaucuaacccugaaaacacagucuuugacgcaaaaagauugauaggaagaaccuggaacgacccuucaguucaacaagacauaaaauuucuaccauuuaaaguaguagaaaaaaaaacaaaaccauauauacaaguugauauuggaggcggucaaacaaaaacauucgcaccagaagaaauauccgcaaugguacuuacaaaaaugaaagaaacagcugaagcauaccuaggaaaaaaaguaacacaugccguaguaacaguaccagcauauuuuaaugacgcccaaagacaagcaacaaaggaugcaggaacaauagcuggucuaaacgucaugagaauaauaaacgaaccaacagcagcagcuaucgcauacggacuagauaaaagagaaggagaaaaaaauauacuaguauuugaucuaggaggaggaacauucgauguaagcuuauuaacaauagacaacggagucuuugaaguaguagcuacaaacggugacacacauuuaggaggagaagacuuugaucaaagaguuauggaacacuuuauaaaacuauauaaaaaaaaaaccgggaaagacguaaggaaagauaacagggccguacagaaacucagaagagaagucgaaaaagcaaaacgagcauuaucaucacaacaccaagcaagaauagaaauagaaaguuucuaugaaggagaagauuuuagcgaaacucuaacgcgagcaaaauuugaagagcugaacauggauuuauuuagaaguaccaugaaaccaguacaaaaaguacucgaagacagugauuuaaaaaaaagugacauagacgaaauaguccuaguaggagguucaacccgaauccccaaaauacaacaacucgucaaagaauuuuucaacggaaaagaaccgagccgaggaauaaacccugacgaagcaguagcauauggcgcagcaguucaagcaggcguauuaagcggagaucaagauacaggagauuuaguacuacuagacguauguccacuaacucuaggaauagaaacagucggaggaguaaugaccaaauuaauaccuagaaacacaguaguaccgacaaaaaaaucacaaauuuucuccacagcaagcgacaaucaaccaacaguaaccauaaaaguauacgaaggcgaaagaccauuaacaaaagauaaccauuuauuaggaacauuugauuuaacagguaucccaccugccccacgaggagucccacaaauagaaguuacauuugaaauagauguaaaugguauccucagagucacagcggaagauaaaggcacuggaaauaagaauaaaauuacuauaacaaacgaccaaaauagauuaacucccgaagaaauagaaagaaugguaaaugaugcggaaaaauucgccgaagaggacaaaaaacuaaaagagagaauagauaccagaaacgaguuagaaucauacgcauacucccuuaagaaucaaauuggagauaaagaaaaauuaggcggcaaauugagcucagaagacaaagaaaccauggaaaaagcaguagaagaaaaaauagaauggcuugaaagccaccaggaugcagauauagaagauuucaaagcaaaaaaaaaagagcuagaggaaaucguacaaccaauaauuucaaaacuauacggaagugcagggccaccaccaacaggagaagaagacaccgcagaaaaagaugaacuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3756 - RNA, 2314 nt, Artificial Sequence
  mRNA product Design2 comprising derived and/or modified sequence from Homo sapiens__NP_002146.2__HsHSPA6 (opt13)
ggggcgcugccuacggagguggcagccaucuccuucucggcaucaagcuuaccaugcaagcaccacgugaacuugcagucgguauagaucuaggaacaacauauuccuguguaggaguauuucaacaagggagaguagaaauauuagcaaacgaucaaggcaauagaacaacaccaucauauguagcauuuacugacacagaaagauugguaggagaugcagccaaaagucaagcagcauuaaauccacauaacacaguguucgacgcgaaaagacuaauugguagaaaauuugcggauacaacaguccaaagugacaugaagcauuggccauuuaggguagugucugaagguggaaaaccaaaaguaagaguaugcuauagaggugaagauaaaacauuuuauccagaagaaauuucaucaaugguauuaagcaaaaugaaagagacagcagaagcauaccuuggacaaccaguaaaacaugcuguaauaacaguucccgcauacuucaaugauagccaaagacaagcaacaaaagaugcuggagcaauagcuggauuaaacgugcuaagaauuauaaaugaaccaaccgccgcggcaauugcauauggauuagauagaagaggagcaggagaaagaaacguauuaauauucgaucuaggaggaggaacauuugacguaucagucuuaucaauagacgcaggcguauucgaaguaaaagcaacagcuggugauacucacuuaggaggagaagauuucgauaacagauuaguuaaucacuucauggaagaauuucgacgaaaacauggcaaagaucuauccggcaauaaaagagcauuaagaagacuacgaacagcgugugaaagagcaaaaagaacauuauccucaucuacccaagcuacauuagaaauagauagccuauucgaagggguagauuuuuacacuuccauaacaagagcucgcuucgaggaacuaugcucagauuuauuuagaucuacuuuagaaccuguagaaaaagccuuacgugacgcaaaauuagauaaagcacaaauacaugacgucguauuaguagguggaaguacccgaauaccaaaaguacaaaaacuauuacaagauuucuuuaacggaaaagaacuaaacaaaucaauuaauccagaugaagcaguugcuuacggcgcagcaguacaggcagcaguauuaaugggagauaaaugugaaaaaguacaagauuuguuacuucuagacguggcaccccuaagccuaggauuagaaacagcaggaggaguaaugaccacauuaauacaaagaaaugcaacaauaccuacuaaacaaacacaaacauuuacaacauauagugacaaucaaccugggguauucauacaaguauaugaaggugaaagagcaaugacaaaagauaauaauuuacuagguagauuugaauuaucagggauuccaccagcaccacgaggaguaccgcaaauagaggugacuuuugacauagacgcaaauggcaucuuaagcguaacagcaacagauagaagcacaggaaaagcaaacaaaauaacaauaacaaaugacaaaggaagguuaagcaaagaggaggucgaaaggaugguacaugaagcagagcaauauaaggccgaagaugaagcccaaagagacagaguagcagcuaaaaauucacuagaagcacauguguuucacguaaaagggagcuuacaagaagagaguuuaagagauaaaauaccagaagaagauagacgaaaaaugcaagauaaaugcagagaaguauuagcauggcuagaacauaaucaacuggcagaaaaagaagaauaugaacaucaaaaacgagaauuagaacaaauaugcagaccaauauucucaaggcuauauggcggaccaggaguaccaggaggaaguucuuguggaacucaagcuagacaaggagacccuucuacaggaccaauaauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3757 - RNA, 1486 nt, Artificial Sequence
  mRNA product Design2 comprising derived and/or modified sequence from Homo sapiens__P48741__HsHSPA7 (opt13)
ggggcgcugccuacggagguggcagccaucuccuucucggcaucaagcuuaccaugcaagcacccagagaauuagccguaggaauagaccuaggaacuacauauagcugugucggaguauuucaacaaggaagaguugaaauauuagcaaaugaccaaggaaauagaacaacaccuucauauguagcauucacagacacagaaagguuaguaggagaugccgcgaaaagccaagcagcauuaaacccacacaauacaguauucgaugcaaaaagacucaucggaagaaaauuugcagauacaacaguacaaucagauaugaaacauuggccauuucaaguagucucagaaggcggaaaaccaaaaguaagaguauguuacagaggagaagauaaaacauuuuauccagaagaaauaucaaguaugguauuaucaaagaugaaagaaacagcagaagcauaucuaggccaaccaguaaaacaugcaguaauaacaguaccaacuuauuucucaaauucacaaagacaagcaacaaaagaugcuggagcaauugcaggucuaaaaguauuaccaaucauaaaugaagcuacagcugcagcaauagcauauggccuagauagaagaggagcaggaaaaagaaauguauuaauauuugauuuaggaggaggaaccuuugacguaucaguauuaucaauagaugcaggaguauuugaaguaaaagcaacagccggagauacacaucuaggaggagaagauuucgacaacagauuaguuaaucacuucauggaagaauuuagaagaaaacacggaaaagacuuaucagguaauaaaagagcacuuagaagauuaagaacagcaugugaaagagccaaaagaacaccaucaagcucaacacaagcgacauuagaaaucgauucacuauucgaaggaguagauuuuuauaaaucaauaacuagagcccgauuugaagaauuauguucagacuuauuucgaagcacacuagaaccaguagaaaaagcacuaagagaugcaaaacuagacaaagcacaaauacacgacuucguauuaggaggaggacuacacagucauccacaaggagcugaaguagcugcaggauuauuacaaagacaaggagcagaacaagaacaccaaccuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3758 - RNA, 2323 nt, Artificial Sequence
  mRNA product Design2 comprising derived and/or modified sequence from Homo sapiens__NP_006588.1 __HsHSPA8 (opt13)
ggggcgcugccuacggagguggcagccaucuccuucucggcaucaagcuuaccaugucaaaagguccugcuguaggaauugacuuaggaacgacauauucguguguuggugucuuccaacaugggaaaguagaaauuauagcaaacgaucaaggaaaccgaacaacaccaucauacguagcuuuuacagauacagaaagauuaaucggagacgcggcuaaaaaucaaguagcaaugaauccaacaaacacagucuuugacgcaaaacgacuaauaggaagaagauuugaugaugcaguaguucaaagcgauaugaaacacuggccauuuaugguaguaaaugacgcaggaaggccaaaaguacaaguagaauacaaaggagaaacaaagagcuucuauccggaagaaguaucaagcaugguauuaacaaaaaugaaagagauagcagaggcauacuuaggaaaaacaguaacaaacgcaguagucacaguuccagcauauuucaacgauagccaaagacaagcaacaaaagacgcagguacaauagcaggauuaaauguacuccggauaauaaacgaaccaacagcugcugcaaucgcguauggacuagauaagaaaguaggcgcagaaagaaauguauuaaucuucgacuuaggaggaggaacauucgauguaucuauucuaacaauagaagacggcauauucgaaguaaaaagcacagccggcgacacacacuuaggaggagaagauuucgauaaccgaaugguaaaccauuucauagccgaguucaaaaggaaacacaagaaagacauaagugaaaauaaaagagcaguacgccgauuaagaaccgcaugugaaagagcaaaaagaacucuaaguucaagcacacaagcgaguauagaaauagacaguuuauaugaagguauagauuuuuauacaucaauaacaagagcaagauucgaagaacuuaacgcagaccuauuuagaggaacacuagacccaguagaaaaagcacuaagagaugcaaaauuagacaaaagccaaauacaugauauaguauuggucggaggaucgacuagaaucccaaaaauacaaaaacuauuacaagacuucuuuaacggaaaagaacucaauaaaucgauuaauccagaugaagcagucgcauauggagcugcgguacaagccgcgauauuaagcggagacaaauccgaaaacguccaagaucuauuacucuuagacguaacaccucugucgcuaggaauugaaacagccggugggguaaugacaguacuaauaaaaagaaacaccacaauaccaacuaaacaaacacaaacauuuacuacauacucagauaaucaaccaggaguccuaauucaaguuuacgaaggggaacgugcaaugacaaaagacaauaauuuacucggaaaauuugaacuaacaggaauaccaccagcaccaagaggaguaccacaaauagaaguaacauuugauauagaugcaaauggaauacuaaacguaagugcgguagauaaaagcacagguaaagaaaacaaaauaacaauaacuaacgacaaaggcagauuaucaaaagaagauauagaaagaauggugcaagaagcagaaaaauauaaagcagaagacgaaaaacaaagagauaaaguaaguaguaaaaauucauuagaaucauacgcauuuaauaugaaagcaacgguagaagaugaaaaauugcaaggaaaaauaaacgaugaagauaagcagaaaauuuuagacaaauguaacgaaauuauaaauugguuagauaaaaaucaaacagcagagaaagaggaauuugaacaucaacaaaaagaauuggaaaaggucugcaauccuauaauaaccaaauuauaccaaucugcgggaggaaugccaggcggaaugccaggaggauucccagguggaggagcuccaccaagcggaggagcaagcaguggaccaacaauagaagaagucgauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3759 - RNA, 2422 nt, Artificial Sequence
  mRNA product Design2 comprising derived and/or modified sequence from Homo sapiens__NP_004125.3 __HsHSPA9 (opt13)
ggggcgcugccuacggagguggcagccaucuccuucucggcaucaagcuuaccaugaucagugcaagcagagcugccgcagcaagauuaguaggagcggcagcaagcagaggaccaaccgcugcuagacaucaagauaguuggaauggauuaucacacgaagcauuuagacucguaaguagacgagacuaugcaagcgaggcaauaaaaggcgcaguaguagggaucgauuuagggacgacaaacucaugcguagcagucauggaaggaaaacaagcaaaaguacuagaaaaugcagaaggagcgagaacaacaccaucaguaguagcguuuacugcagauggagaaaggcuaguaggcaugcccgcuaaaagacaagcaguaacaaauccaaauaauacauuuuaugcaacaaaaagauuaauaggaagaagauaugaugacccagagguacagaaagacaucaaaaauguaccuuuuaaaauaguaagagcaaguaacggagacgcauggguagaagcacaugguaaacuauauaguccgucgcaaauaggagcauuuguucuuaugaaaaugaaagaaacggcagaaaauuaucuagggcauacagccaagaacgcaguaauaacaguacccgcauauuucaacgauucacagcgucaagcaacgaaagaugcgggacaaauuagugggcugaauguauuaagaguaauaaacgaacccacagcugcagcccuagcguauggacucgauaaaucagaagacaaaguaaucgcaguauaugauuuaggugggggaaccuuugacauuucaauauuagaaauacaaaaaggcguauuugaaguaaaaaguacaaauggagauacauucuuaggaggagaagacuucgaucaagcucuauuacgacauauagugaaagaguucaaaagagaaacaggaguugacuuaacaaaagauaacauggcacuacaaagaguaagagaagcagcugaaaaagcgaaaugcgaacuaaguaguaguguacaaacagacauaaacuuaccauacuuaacaauggacucaucagggccaaaacaucuuaacaugaaacugacuagagcacaauucgaaggaauagucaccgaucuaauacguaggaccauugcaccaugccagaaagcaaugcaggacgcagaaguaucgaaaagcgauauaggagaaguaauauuaguugggggaaugacaagaaugccuaaaguacaacaaacaguacaagauuuauuuggaagggcaccaucaaaagcaguaaacccagacgaagcaguggcgauaggagccgcaauacaaggaggaguacuagcaggagacguaacugauguuuuauuacuagauguaaccccacuaaguuugggaauagaaacauuaggaggaguauuuacaaaacuaauaaauagaaauaccacaauaccuacaaagaaaucucaaguauuuucaacagcagcagacggccaaacacaaguggaaauaaaaguaugucaaggcgaaagagaaauggcaggagacaauaaacuguuaggacaauuuacuuuaauagguauaccaccagcaccaaggggaguaccucaaauugaaguaacauucgacauagacgcaaauggaauaguccauguaucagcgaaagauaagggcacagggagggaacaacaaauaguaauacaaaguagcggaggacugaguaaagacgauauagaaaauauggucaaaaaugcugaaaaauaugcugaagaggauaggaggaagaaagaaaggguagaagcgguaaauauggcagaaggaauaauacaugacacagaaacaaaaauggaagaauuuaaagaucaauuaccagcggaugaauguaauaaacucaaagaagaaauaaguaaaaugagagaguuacuugcaagaaaagauucagaaacgggagaaaauauacgacaagcagcaaguucacuacaacaagcuagucuaaaauuauucgaaauggccuauaagaaaauggcaucggaacgagaaggaucaggaucaucugguacaggggaacaaaaagaagaucaaaaagaagaaaaacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3760 - RNA, 2410 nt, Artificial Sequence
  mRNA product Design2 comprising derived and/or modified sequence from Homo sapiens__NP_079291.2__HsHSPA12A (opt13)
ggggcgcugccuacggagguggcagccaucuccuucucggcaucaagcuuaccauggcugauaaagaagccggaggaucugauggcccuagagaaaccgcaccaacuucagcauauagcagccccgccagaucauuaggagauacaggcauaacucccuuaucaccaucccauauaguaaacgauacagauaguaaugucuccgaacaacaaucauuuuugguuguuguagcagucgauuucgguacaacaagcuccggauacgcauauuccuucacaaaagaaccggaauguauacauguuaugagaagaugggaaggcggcgacccaggaguuaguaaccaaaagacuccaacuacaauccucuuaacaccggaaaggaaauuccauucauucggauaugccgcacgcgauuuuuaccacgauuuagacccaaacgaagcgaaacaaugguuauaucuagaaaaauuuaaaaugaaacuacauaccacaggagaccuuacuauggauacagaccuaacagcugcaaauggaaagaaaguaaaagcauuagaaaucuuugcauacgcguuacaauacuuuaaagaacaagccuuaaaagaauuaagcgaccaagcuggaucagaauuugaaaauuccgacguacgaugggucauaacgguaccugcaauauggaaacaaccagcaaaacaauucaugagacaagccgccuaucaagcuggacuagcgucaccagaaaacagcgaacaacuaauaauagcacuagaaccagaagcagcaucaaucuauuguagaaaacuaagauuacaucaaaugauagaacuaucaucaaaagcugcaguaaauggauauucaggaagugacaccguaggugcaggauuuacucaagccaaagaacacauaagaagaaauagacaaucuagaaccuuucuagucgaaaauguaauuggcgaaauauggucugaauuagaagaaggagacaaauaugucguaguugacuccgguggaggaacaguggaucucaccguccaucaaauacgacuaccagaaggacaucuuaaagaacucuacaaagcuacaggaggaccauauggcucauuaggcguagauuaugaauuugaaaaacugcuauacaaaaucuucggagaagacuuuauagaacaauuuaaaaucaaaagaccagcagcauggguagauuuaaugauagcauucgaaucaagaaaaagagcugcagcaccagaucgaacuaauccguuaaauauaacguuaccauucucauucauugacuacuauaaaaaguuuagaggucauaguguugaacaugcacuaagaaaaucgaauguagauuuuguaaaauggucaagucaaggcauguuaagaaugucaccagaugccaugaaugcauuauuuaaaccaacuauagauucaauaauagaacauuuaagagacuuauuccaaaaaccagaaguaucuacaguuaaauucuuauuccuaguagggggauuugcagaagcuccacuucuacaacaagcagugcaagcagcauucggcgaccaaugucgaauaauaauaccucaagacguaggccucacaauacuaaaaggagcgguauuauuuggauuagauccugcagucauaaaaguaagaagaucaccucuaacauacgguguaggaguacuaaacagguacguagaaggaaaacacccaccugaaaaacuuuuagucaaagacggaacuagauggugcacagauguauuugauaaauucauaucagcagaucaaucaguagcauuaggagaacugguaaaacgaucauacacuccugcuaaacccagccaauuaguaaucguaauaaauauauauucaagugaacaugauaaugucucauuuauaacagauccaggaguaaagaaaugcggaacauugagauuggaccucacaggaacaucaggaacagcuguaccagcaagacgagaaauucaaacacuaaugcaauuuggagauaccgaaauaaaagcaacugcaauagauauagccaccagcaaaaguguaaaagugggaaucgauuucuuaaauuauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3761 - RNA, 2443 nt, Artificial Sequence
  mRNA product Design2 comprising derived and/or modified sequence from Homo sapiens__NP_443202.3 __HsHSPA12B (opt13)
ggggcgcugccuacggagguggcagccaucuccuucucggcaucaagcuuaccaugcuagcaguaccugaaaugggauuacaaggucuauauauagguagcucgccagaacgaucaccaguaccaaguccgccgggaucaccucgcacacaagaaagcuguggaauugcaccacuaaccccuucucaaucaccaaagccagaaguuagagcaccccaacaggcuucauuuucuguaguaguagcaauagacuuuggcaccacauccucaggcuaugccuucagcuuugcaucagacccagaagcgauacauaugaugaggaaaugggaaggaggagauccagggguagcacaucagaaaacaccuacuugcuuauuacuaacaccagaaggcgcauuucauaguuuuggauauacagcaagagacuauuaucaugaucuggauccugaagaagcgcgugauugguuauauuuugaaaaauuuaaaaugaaaauccauucagcaacagaucuaacuuuaaaaacacaauuagaagcugucaauggcaaaacaaugccagcauuagaaguauuugcccaugcacuaagauuuuuccgagaacaugcacuacaagaacuuagagaacaauccccaaguuuaccugagaaagauacaguaagauggguauuaacagugccggcaauauggaaacaaccugcuaaacaauucaugagggaagccgccuauuuagcaggauugguuucacgagaaaacgcagaacaacuauugauagcuuuagagccagaggcggcaaguguauauuguagaaaacuaagauuacaucaacuacuagauuuaucaggcagagcuccaggaggagguagauuaggagaaagacgauccauugauucuaguuuuagacaagcuagagaacaacuaagaagaagcagacauucaagaacauuccuuguagaaaguggaguaggagaauuaugggcagaaaugcaagcaggagauagauauguaguugcagacuguggaggaggaacuguagaccucacaguucaucaacuagaacaaccacaugguacccuaaaagaauuauauaaagcgaguggcggcccauacggagcaguaggcguagauuuagcauuugaacaauuacucugucgaauauuuggagaagauuucauagcuacuuuuaaaagacaaagaccagcugcauggguagaucuaacuauagcuuucgaagcaagaaaaagaacagccggaccucauagagcaggagcauuaaauauaucucuaccauuuaguuuuauagauuuuuacagaaaacaacggggacauaacguagaaacggcauuacgaagaucaagugucaacuucguaaaauggucaucacaagguauguuaagaauguccugugaagcaaugaaugaacuauuucaacccacuguaagcggaauaauacaacacauagaagcauuauuagcaagacccgaaguucaaggaguaaaauuacuauuucuaguaggaggguuugccgaaucggcaguucuacaacaugcaguacaagcugcguuaggcgcacgaggauuacgaguaguaguaccccacgauguugggcuuacaauucugaaaggagcuguauuauuuggacaggcaccaggaguagucagaguuagaagaagcccacuaacauaugggguaggaguacuuaacagauuuguaccaggcaggcauccuccagaaaaauuauuaguacgagacggaagacguugguguacagauguauucgaaagauucguugcagcugaacaaagcguugcauuaggagaagaaguaagacgaucauauugcccagcuagaccaggucaaagaagaguucuaauaaacuuauauuguugcgccgcagaagaugcaagguuuauuacugauccuggaguucgaaaauguggugcacuuagccuagaacuagaaccggccgauuguggacaagauacagccggagcaccaccagguagaagagaaauaagagcugcuaugcaauucggagacaccgaaauaaaagucacagcaguagaugucagcacaaauagaucagugcgagcuaguauagacuuucuaucaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3762 - RNA, 1798 nt, Artificial Sequence
  mRNA product Design2 comprising derived and/or modified sequence from Homo sapiens__NP_008879.3__HsHSPA13 (opt13)
ggggcgcugccuacggagguggcagccaucuccuucucggcaucaagcuuaccauggcacgagaaaugaccauauuaggaagcgccguauuaacauuauuacuagcgggauauuuagcacaacaauaucuaccccuacccacaccaaaaguaaucggaauagacuuaggaacaacauauuguaguguaggaguuuucuucccaggaaccggaaaagucaaaguaauaccagacgaaaacggacacauaucaauuccaucaaugguaucauuuacugauaacgacguauauguaggauacgaaucaguagaauuagccgauagcaauccacaaaacacuauauaugacgcaaaaagauucauaggcaaaauauuuacagcagaagaacuugaagcugaaauaggaagauaucccuuuaaaguacuaaauaaaaacggaaugguagaauucucaguuacaucaaaugaaacaauaacagucaguccagaauacguagguagcagauuacuacuaaaacuaaaagaaauggcagaagcauacuuaggaaugccaguagcaaaugccguaauaucuguaccagcagaauucgauuuaaaacaacgaaauucaacaauagaagcagcuaaucuagcaggacuaaaaauauuaagaguuauaaacgaacccacagcagcagcaauggccuauggauuacacaaagcugacguauuucauguacuaguaauagaucuagguggagguacauuagacguaagcuuacuaaauaaacaaggaggcauguuucuuacacgagcaaugucaggcaacaacaaauuaggaggucaagacuuuaaccaaagacuacuacaauaucucuacaaacaaauuuaccaaacuuauggauuuguuccuucaagaaaagaagaaauacaucgauuacgacaagcaguagagaugguaaaacuaaauuuaacacuacaucagagugcacaacuuuccgucuuauuaacaguugaagaacaagaucgaaaagaaccacacaguucagacaccgaacuuccaaaagauaaauuaagcucagcagaugaccauagaguuaacagcggcuuuggaagaggauuaucagacaaaaaaagcggagaaagccaagugcuguuugaaaccgaaauaagcagaaaauuauucgauacacuuaacgaagaccuauuccaaaaaauauuaguaccaauccaacaaguacuaaaagaaggucaucuagaaaaaacagaaauagaugagguaguauuaguaggaggaucaacacguauacccagaauaagacaaguaauacaggaauuuuucggaaaagauccaaauacaucaguagacccagauuuagcgguuguuacaggagucgcaauacaagcaggaauagauggcggaagcuggccauuacaaguauccgcacuagagaucccaaacaaacaucuacaaaaaaccaauuucaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3763 - RNA, 1912 nt, Artificial Sequence
  mRNA product Design2 comprising derived and/or modified sequence from Homo sapiens__NP_057383.2__HsHSPA14 (opt13)
ggggcgcugccuacggagguggcagccaucuccuucucggcaucaagcuuaccauggcagcaauaggaguacauuuaggauguacaagugcauguguagcaguauauaaagauggaagagcaggaguaguagccaaugaugcaggggauagaguaacaccagcgguaguagcuuauucagaaaaugaagaaauaguaggauuagcugcaaaacaaucaagaauaagaaauauuaguaacaccguaaugaaagugaaacaaauacuaggaagaucuucaucagauccccaagcacaaaaauauauagcagaaucaaaaugucuaguaauagaaaaaaauggcaaacuaagauaugaaauagauacaggcgaagaaacaaaauuuguaaacccugaagaugucgcuagacuaauauucucaaaaaugaaagaaacagcacauucaguacuaggaucagaugcaaaugacguaguaauaaccguaccauuugauuuuggagaaaaacaaaaaaaugcauuaggagaagcagcaagagcagcaggauuuaacguguuacgacuuauacaugaacccucagcagcauuauuagccuauggaauaggucaagacucaccaacaggcaaaucaaauauauuaguauuuaaauuaggaggaacuagucuaucacucucaguaauggaaguaaauucaggaauauacagaguuuuaucaacuaauacagaugauaauauuggaggagcacauuuuacagaaacauuagcucaauaccuugcaagugaauuucaaagaaguuuuaaacacgaugucagaggaaaugcaagagcaaugaugaaacuaacgaauucagcagaaguagcaaaacauucauuaucaacauuagggucugccaauuguuuccuagauagucuuuaugaagggcaagacuuugacuguaauguaagucgagcaagauuugaacuacuguguucaccccuguuuaacaagugcauagaagcaauaaggggauuacuagaucaaaauggcuucaccgcagaugacaucaauaaaguaguacuauguggaggaagcucaagaauaccaaaacuccaacaauuaauaaaagauuuauuucccgcuguagaacuacuaaauaguauacccccagaugaaguaauaccaauaggugccgcaauagaagcaggcauauuaauaggcaaagagaaucuacuaguggaagacagucuaaugauagaauguagugcaagagacauauuaguaaaagggguagaugaaaguggagcaagcagauuuacaguauuauuccccagcggaacaccucuaccagcaagaagacaacauacucuacaagcgccagguucaauaucaucaguuugccuagaacuauacgaaucagacgguaaaaacucagcaaaagaagaaacaaaauucgcucaaguaguacuacaagauuuggacaaaaaagagaauggacuaagagauauucuagccguauugacuaugaaaagagauggaucacuacacguaacauguacagaccaagaaacaggaaaaugugaagcaaucucuauagaaauagccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3764 - RNA, 2959 nt, Artificial Sequence
  mRNA product Design2 comprising derived and/or modified sequence from Homo sapiens__NP_006635.2 __HsHSPH1 (opt13)
ggggcgcugccuacggagguggcagccaucuccuucucggcaucaagcuuaccaugaguguuguggggcuagacguagggagccaaaguugcuauauagcaguagccagagccggaggaauagaaacgauagcaaaugaauucucagauagaugcaccccaaguguaauaucauucggaucaaaaaacaggacgauaggaguggcagccaaaaaucaacagauaacgcacgcaaauaacacagucagcaacuuuaaaagauuucacggaagagcauuuaacgacccauuuauacaaaaagaaaaagagaaucuaaguuacgacuuagucccccuaaaaaauggaggagugggaauaaaaguaauguauaugggcgaagaacaccuuuuuucaguugaacaaauaacugcgaugcuauuaacaaaacuaaaagaaacagcagaaaacucauuaaaaaaaccaguaacagacugcguaauaucaguaccaucauucuuuacagacgcugaacgacgaaguguucuagacgcagcacagauaguagguuugaauugucuaagacugaugaacgacaugacagcaguagcguuaaacuacggaauauacaaacaggaccuaccaagcuuggacgagaaaccuagaauaguaguauucguagacauggggcacucugcauuccaaguuagugcaugcgcauucaauaaagguaaacucaaaguauuaggaacagcauuugacccauucuuaggaggcaaaaacuuugacgaaaaacuuguugaacauuucugcgcggaauucaaaacaaaauauaaauuggacgccaaaagcaaaauaagagcccuuuuacgacuauaccaagagugcgaaaaacuaaaaaaacuaaugaguaguaauucaacugaccuaccacucaauauugaguguuucaugaaugauaaagauguaaguggcaaaaugaacagaucucaauucgaagaauuaugcgccgaauugcuacagaaaauagagguaccacuauauagccuccuagaacaaacacaucuaaaaguagaagauguuagugcaguggaaauaguaggaggcgcuacaagaauaccugcaguuaaagaaagaaucgcuaaauucuucggaaaagauauauccacaacacuuaaugcagacgaagcaguagcucgcggcugcgcucuccaaugugccauucuaaguccagccuucaaagucagagaauucucuguaacugacgcaguuccguucccuauaucacuuauauggaaccacgacagugaagauacugaaggagugcaugaaguauucagcaggaaccaugccgcuccuuucagcaaaguauuaacuuucuuacgaaggggaccauucgaauuagaagcauuuuacucagauccacaaggaguaccauacccugaagcaaaaauaggccgauucguaguacaaaacgucagcgcacaaaaagauggagaaaaaucaagagucaaaguaaagguacguguaaauacccacgguauuuucacaauaucaacagcauccaugguagaaaaaguaccuacagaagaaaaugaaaugucaagcgaagcagauauggaaugcuuaaaucaaagaccaccagaaaacccagauacagacaaaaacguacaacaagauaacucagaagcaggaacacaaccacaaguacaaaccgaugcucaacaaaccucacaaucaccuccaagcccagaacuuacuucugaagaaaacaaaaucccagacgcagauaaagccaacgaaaaaaaagucgaccaaccaccagaagcuaaaaaaccaaaaauaaaaguaguaaacguagaacugcccauagaagcaaaccuaguauggcaacuaggaaaagauuuauuaaacauguacauagaaacugaaggcaaaaugaucaugcaagauaaacuagaaaaagaacgcaaugacgcaaaaaacgcaguagaagaauauguauaugaauuuagagacaaauuauguggaccauaugaaaaauucauaugcgaacaagaucaccaaaauuuccuacgacuacucacugaaacagaagacugguuauaugaagaaggagaagaccaagcaaaacaagcuuacguagacaaacuggaagaacuaaugaaaauagguacgccuguaaaaguacguuuccaagaagcagaagaaagaccgaaaauguuugaagaauuaggacagagacuccaacacuaugcaaaaauagcugcagacuuccgaaacaaagaugaaaaauauaaccacauagaugaaagcgaaaugaaaaaaguugaaaaaucagucaacgaaguaauggaauggaugaacaacguaaugaaugcacaagcaaaaaaaagucuagaccaagacccaguagucagggcgcaagagauaaaaacgaaaaucaaagaauuaaauaacacuugcgaacccgucguaacgcaaccaaaaccuaaaauagaaucaccaaaacuagagcgcacgccuaaugguccaaacauagacaaaaaagaagaggaccuagaagauaaaaauaacuuuggugcagaacccccccaucaaaacggagaaugcuauccaaacgaaaaaaauaguguaaauauggaucuagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3765 - RNA, 3382 nt, Artificial Sequence
  mRNA product Design2 comprising derived and/or modified sequence from Homo sapiens__NP_006380.1 __HsHYOU1 (opt13)
ggggcgcugccuacggagguggcagccaucuccuucucggcaucaagcuuaccauggcugauaaaguaagaagacaaagacccagaaggagaguuuguugggcucuaguagcaguauuacuggcagauuuauuagccuuaucagauacccuugcaguaauguccguagaccuaggaagugaaaguaugaaaguagcaauaguuaaacccggaguaccaauggaaauaguccuuaacaaagaaucuagaaggaaaacuccaguuauaguaacacuaaaagaaaaugaacgauucuucggcgacagugcagcaucaauggccaucaaaaauccaaaagcaacauuaagauacuuucaacaucuucuuggcaaacaagcugauaauccucaugucgcauuauaucaagcaagauuccccgaacacgaacuaacuuuugacccacaacgucaaacuguacacuuucaaauaaguucacaacuacaauuuaguccagaagaaguacucggaaugguccugaauuauucaagaucauuagcagaagauuucgcagaacaaccuauaaaagacgcaguaauaaccguuccuguguucuuuaaccaagccgaaaggcgagcaguauuacaagcagcucgaauggcaggauuaaaagucuuacaauugauaaaugauaauacagcaacagcacuuaguuacgggguauuuagacgaaaagauaucaauacgacagcucaaaauauaauguuuuaugacaugggaaguggcucaacagucugcacaauaguaacauaucaaauggucaaaacaaaagaagccgggaugcaaccacaacugcaaauacgagguguaggauucgauagaaccuuagggggacuagaaauggaauuaagauuacgagaaagauuagcaggauuauuuaacgaacaaaggaaaggccaacgugcaaaggauguaagagaaaauccaagagcgauggcaaaacuccugagagaggcuaauaggcuaaaaacggugcuaagcgcaaaugcggaccauauggcacaaauagaaggguuaauggaugacguagacuuuaaagccaaaguaacacgcguagaguucgaagaauuaugugcugaucuauuugaaagaguaccggguccaguucaacaagcguuacaaucggcagaaaugucacuugaugaaauagaacaaguaauuuuaguagggggcgcuaccaggguuccuaggguacaagaaguccuauugaaagccguggggaaagaagaauuagguaagaauauaaacgcagaugaagcugcugcaaugggugcaguguaucaagcagcagcacuaagcaaggcauuuaaggugaaaccguucguuguaagggaugcuguagucuauccaauauuaguagaauuuacucgcgaaguagaagaagaaccaggaauacauuccuuaaaacauaauaaaagagucuuauucagcaggaugggacccuauccucagagaaaaguaauaaccuucaaccgauacagucaugacuucaauuuccacauaaacuauggagauuuaggauuucuugguccggaagacuuaagaguauuuggaagucaaaaucuaacaaccguaaaauuaaaaggcgugggagacucauuuaagaaguaucccgauuacgaaucaaaaggaauuaaggcacauuuuaacuuagacgagagcggagucuuaagccuggacagaguggaaucaguauucgaaacguugguugaagauucagcugaagaagaaaguacacuaacgaaauugggaaacaccauaaguucucuauucggaggaggcacaacuccagaugcaaaagaaaaugguacagauacuguccaagaagaagaagaaucaccagcagaaggauccaaggacgaaccaggagagcaaguugaacuuaaagaagaagcagaagcacccguugaagauggaucacaaccuccaccacccgaaccgaaaggagacgccacgccggaaggagaaaaagcaacugaaaaagaaaauggagauaaaucagaagcacaaaaaccaucugaaaaagccgaggcaggaccagaagguguagcucccgcuccggaaggugaaaagaaacaaaaaccagcacgaaaaagacgcauggucgaagaaauaggaguagaauuaguaguuuuagacuuaccugaucucccagaagacaaacucgcacaaucaguacaaaaacuacaagaucuaacauugagagaucuggagaaacaagaaagagaaaaagcagcuaauagucuagaggcuuucauuuucgaaacccaagacaaauuauaccaaccugaauaccaggaaguuuccacagaagaacaaagggaagaaaucagugguaaauugagcgcagcuaguacaugguuagaagaugaaggaguuggagcaacgacaguaauguuaaaagaaaaauuagcagaauuaaggaaauuaugucaaggacucuucuuuagagucgaagaaagaaagaaauggcccgagagauugucagcauuagacaauuuauuaaaccauuccagcauguucuuaaaaggugccagacuuauaccagaaauggaucagauauuuacagaaguggaaaugacuacacuagaaaaaguaauuaacgaaaccugggcauggaaaaaugcaacacuagcagaacaagccaaauuaccggcgacggagaaaccaguacuauuaucgaaagauauagaagcaaaaaugauggcucuagaccgagaaguccaauaccuuuuaaacaaagccaaauuuacaaaaccaaggccaagaccuaaagacaaaaauggaacaagagcggaaccaccacuaaacgcgagcgcaagugaccaaggugaaaaaguaauuccaccagcuggacaaacagaagacgcugaacccauaagugaaccagaaaaaguagaaacaggaucagaacccggagauacugaaccacuagaguugggaggaccaggggcugagcccgaacaaaaagaacaaucaacaggccagaaaagaccgcucaaaaacgaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3766 - RNA, 2581 nt, Artificial Sequence
  mRNA product Design2 comprising derived and/or modified sequence from Homo sapiens__NP_005339.3 __HsHSP90AA1 (opt13)
ggggcgcugccuacggagguggcagccaucuccuucucggcaucaagcuuaccaugccagaagaaacgcaaacacaggaccaaccaauggaagaagaagaaguugaaacauuugccuuccaagcugaaaucgcucaacuaaugucccucauaauaaacacauuuuacaguaauaaggaaauauuccuacgagaauuaauaucaaauaguagugacgcauuagauaaaauacguuacgaaagccuaacagauccgaguaaacuagacucaggaaaagaacuacacauaaacuuaauaccaaacaaacaagaccgaacacucacaauaguagacacagguauaggcaugacgaaagccgauuuaauaaacaaccucggaaccauugcaaaaagcggaaccaaggcauucauggaagcucuacaagcaggagcggacaucagcaugauaggccaguucggaguggguuucuauucagcauaccucguagcagaaaaaguaaccgucauaacgaagcacaacgacgaugaacaauaugcaugggaaucauccgccggaggaaguuucacaguccgaacugacacaggugaacccaugggaagagguacuaaaguaauccuucaucugaaagaagaucaaaccgaauaccucgaagaacgacgaauaaaagaaauuguaaaaaagcauucacaauucaucggauacccuauaacacucuucguagaaaaagaaagggauaaagaaguaagcgaugaugaagcagaagaaaaggaagacaaagaagaagaaaaagaaaaagaagaaaaagaaucagaagauaaaccagaaauagaagacguaggauccgacgaagaagaagaaaaaaaagacggugacaaaaaaaaaaaaaaaaagauaaaagaaaaauacauagaccaagaagaauuaaauaaaaccaaaccgauauggacgagaaaucccgacgacauaaccaacgaagaauacggagaauucuauaaaagccugaccaacgacugggaagaccaucuggcagucaaacacuucaguguagaaggacaauuagaauucagagcacuacuauuuguaccgagacgagcaccauucgacuuauucgaaaauagaaaaaaaaaaaacaacauaaaauuguacguaagaagggucuucauaauggacaauugugaagaacuaauacccgaauaucuaaacuucauuagaggcguuguagacucagaagaccuuccacucaauauaucaagagaaauguuacaacaaaguaaaauacugaagguaauaaggaaaaauuuaguaaaaaaaugcuuggaacuauucacagaacuagcagaagacaaagaaaacuacaaaaaauuuuaugaacaauucucaaaaaacauaaaguuaggaauucacgaagauagccaaaauagaaagaaacuaucugaauuguuacgauauuauacauccgcaucaggugacgaaauggugucguuaaaagauuacugcacacgaaugaaagaaaaccaaaaacauauauauuacauaacaggagaaacaaaagaucaaguagcaaacagcgcauucgucgaacgacugagaaagcacggauuagaaguaauauacaugauagaaccaauagaugaauauuguguacaacaauuaaaagaauucgaaggaaaaacucucguaucaguaacaaaggaaggacuugaacuaccagaagaugaagaagaaaaaaaaaaacaagaagaaaaaaagacaaaauuugaaaaccucugcaaaauaaugaaagacauacuggaaaaaaaaguagaaaaaguaguagucucaaacagacuagugaccucaccuuguuguauagucacaagcacauauggauggaccgcaaacauggaaagaauaaugaaagcacaagcauuaagagauaacucaacaauggguuacauggcagcuaaaaaacaucucgaaauaaauccagaucauucuauaauagaaacucuuagacaaaaagcagaagcagauaaaaacgacaagaguguaaaagacuuagucauacuauuauacgaaacggcacuacucagcaguggauuuaguuuagaagauccacaaacacacgcgaacaggaucuacagaaugauuaaacuaggauuaggaaucgaugaagaugacccaacagcagacgacacaucagcagcaguaacagaagaaaugccaccacuagaaggggacgaugacacuagccgaauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3767 - RNA, 721 nt, Artificial Sequence
  mRNA product Design2 comprising derived and/or modified sequence from Homo sapiens__NG_005218__HsHSP90AA3P (opt13)
ggggcgcugccuacggagguggcagccaucuccuucucggcaucaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauucauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3768 - RNA, 2557 nt, Artificial Sequence
  mRNA product Design2 comprising derived and/or modified sequence from Homo sapiens__NP_031381.2__HsHSP90AB1 (opt13)
ggggcgcugccuacggagguggcagccaucuccuucucggcaucaagcuuaccaugccagaagaaguacaucauggagaagaagaagucgaaacguuugcuuuccaagcggaaauagcgcaacuaaugagccuaauaauaaacacauucuauaguaacaaagaaaucuucuugagggaauuaauuucaaacgccuccgaugcauuagacaaaauaagauacgaaagcuuaacagacccaucaaaauuagauagcggaaaagagcuaaaaaucgacauaauaccuaacccacaagaacguacacugacacuuguagauacaggaauaggaaugacaaaagcagaccuaauaaacaaccuaggaacuauagcuaaaucaggcacgaaagccuucauggaagccuuacaagcaggagcagauauaucaaugauaggacaauuuggagugggauucuacagcgcauaccuaguagcagaaaaaguagucguaauaaccaaacauaaugacgacgaacaauacgcaugggaaagcucggcaggaggcagcuuuacaguaagagcagaucauggcgaaccuauaggaaggggcaccaaagucauccuacaucucaaagaagaucaaacagaauauuuagaagaaagacgagugaaagagguagucaaaaagcauucccaauuuauaggcuauccaauaaccuuauaccuagaaaaagaaagagaaaaagaaauaucagacgacgaagccgaagaagaaaaaggagaaaaagaagaagaagauaaagacgaugaagaaaaaccaaaaauagaagauguaggaagcgaugaagaagacgacucaggaaaagacaaaaaaaaaaagacaaaaaaaauaaaagaaaaauauaucgaucaagaagaacucaacaaaacaaaacccauauggacaagaaauccagacgacauaacacaggaagaauacggagaauucuauaaaagccuuacgaaugacugggaagaucaucuagcaguaaaacacuucucuguagaaggacaacuagaauuccgagcccuacuauucauaccaagacgcgcaccauucgaccuauucgaaaauaaaaaaaaaaaaaacaauauaaaauuauauguacggagaguguucauaauggacaguugcgaugaacuaauaccagaauacuuaaacuuuauaagaggagugguagacucagaagaccuaccccuaaauauaagccgggagauguuacaacaaagcaaaauauuaaaaguaaucaggaagaacauuguaaaaaaaugucuggaacuauuuucagaguuagcagaagauaaagaaaacuacaaaaaauucuacgaagcauucucaaaaaauuuaaaauuagggauacaugaagacagcacaaacagaagaagacugagcgaacuacuaagauaucauacaagucaaaguggagacgaaaugacuucacuaagugaauacguaucaagaaugaaagaaacacaaaaaucuauuuacuacauaacuggagaaucaaaagaacagguagcaaacagcgcauuugucgaacgaguaagaaaacgaggauucgaaguaguuuauaugacagaaccuaucgaugaauauugcguccaacaacuaaaagaauuugacggaaaaucacuugucaguguaacaaaagaaggacuagaacugcccgaagacgaagaagaaaaaaaaaaaauggaagaaucaaaggcuaaauucgaaaaucuaugcaaauuaaugaaagaaauacucgacaaaaaaguagaaaaaguaaccauaagcaaucgacuaguaucaaguccuugcuguauagucacaucaacauauggauggacagcgaauauggaaaggauaaugaaagcccaagcacuuagagacaauaguacaaugggauacaugauggccaaaaagcaucuagaaauaaauccugaccacccaaucguagaaacacuaagacaaaaagcagaagcagauaaaaacgacaaagcaguuaaagacuuaguugucuuauuauucgaaacagcacuacucucaaguggauucucacuagaagacccccaaacacauaguaacagaauauaccgaaugauuaaauugggauuaggaaucgacgaagacgaaguggcagccgaagaaccaaaugccgcaguacccgaugaaauaccaccccuagaaggagacgaagacgcaaguagaauggaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3769 - RNA, 2794 nt, Artificial Sequence
  mRNA product Design2 comprising derived and/or modified sequence from Homo sapiens__NP_003290.1__HsHSP90B1 (opt13)
ggggcgcugccuacggagguggcagccaucuccuucucggcaucaagcuuaccaugagggcauuauggguucuaggacuauguugcguacuacuaacguucggaucaguaagagcagacgaugaaguagaugucgauggcacaguagaggaagaccuaggaaaaucaagagaaggaagccguacagacgacgaaguagugcaaagagaagaggaagcaauccaguuggauggacuaaaugcaagucaaauaagagaacuaagagaaaaaucagaaaaauucgcauuucaagcagaagugaacagaaugaugaaacuaauaaucaauucauuauauaaaaacaaagaaauauuccugagagaacuaauaagcaacgcaagugaugcuuuagauaaaauacgacuaauuagcuuaacagacgaaaaugcauuaagcggaaaugaagaguuaacaguaaaaauaaaaugugacaaagaaaaaaacuuacuccaugugacagacacaggaguaggaaugacccgcgaggaauugguaaaaaaucuaggaacgauagcuaaaagcggaacaagugaauuucuuaauaaaaugacagaagcacaagaagacggccaaucaacaagugaacuaauaggacaauucggaguugguuuuuauagugcuuuuuuaguugcugacaaaguaauagucacgucgaaacauaauaacgacacacaacacaucugggaaagugacucgaaugaauuuucaguuauagcagauccaagaggaaauacgcuaggcagagggacaacaauaacauuaguacuuaaagaagaagcaucagauuauuuagaauuagauacaauaaaaaaccuaguaaaaaaauauagucaauucauaaauuuccccauauauguauggaguaguaaaacagaaacgguagaagaaccaauggaagaagaagaagcagcuaaagaagaaaaagaggaaagugacgaugaagcagcaguugaagaagaagaagaagaaaaaaagccgaaaacuaaaaaagucgaaaaaacgguaugggacugggaacuuaugaacgauauaaagcccauauggcagagaccgagcaaagaaguagaagaagaugaauauaaagcauuuuacaaaucauuuaguaaagaaucagacgauccaauggcuuacauacauuuuacagccgagggagaaguaacauucaaaucaauuuuguuuguaccaacaagugcucccagagggcuauucgaugaauacggaucaaaaaaaagcgacuauauaaaacucuauguaagaagaguauucaucaccgacgacuuccacgauaugaugccuaaauaccuaaauuucguaaaaggagucguagauagugaugacuuaccauuaaauguaagcagagaaacucuccaacaacauaaauuacuaaaagugauacguaaaaaauuaguaagaaaaacacucgacaugauaaaaaaaauagcggaugauaaauauaaugauacauucuggaaagaauucggaacaaauauaaaacuuggcguaauagaagaucacucuaauagaacaagacuagcaaaacucuuaagguuccaaagcucacaucacccaaccgauauaacuucauuagaucaauauguagaaaggaugaaagaaaaacaagauaaaauauauuuuauggcaggaucaucaagaaaagaagcugaaaguagcccauucgucgaaagacuucuuaaaaaaggguaugaaguuauauauuugacagaaccaguagaugaauauuguauacaggcacuaccagaauucgaugguaaaagauuccaaaacguagcaaaagaaggcguaaaauucgacgaaagugagaaaacuaaggaaucacgagaagcgguagaaaaagaauucgagcccuuacucaauuggaugaaagacaaagcacuaaaagauaaaaucgaaaaagcuguggucagucaaagauuaacagaaucaccaugcgcauuaguugcaagucaauauggguggucaggaaauauggaaagaauaaugaaagcgcaagcauaucaaacuggaaaggauauaucgacuaacuacuacgcaucgcaaaagaaaacauucgaaauaaauccuagacacccauuaauaagagacaugcuacgaagaaucaaagaagaugaagacgacaagacaguacuagaucuagcaguaguauuauuugaaacagcaacauuaagaucggguuaccuucuuccggauacaaaagcauacggcgacagaauagaaagaaugcucagacuaucacucaacaucgacccagaugcaaaaguggaagaggaaccagaagaagaaccagaagaaacagcagaagauacgacagaagacacugaacaagaugaggacgaagaaauggacgugggaacugacgaagaagaagaaacugcaaaagaaagcacugcugagaaagaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3770 - RNA, 2497 nt, Artificial Sequence
  mRNA product Design2 comprising derived and/or modified sequence from Homo sapiens__NP_057376.2__HsTRAP1 (opt13)
ggggcgcugccuacggagguggcagccaucuccuucucggcaucaagcuuaccauggcaagagaacuaagagcucuauuacucuggggaagaagacuacgaccauuauuaagagccccugcauuagcagcugucccaggcgguaaaccuauccuauguccaagaaggacgacagcgcaauuaggaccuagaagaaauccagcuuggagcuuacaagcagguagauuauuuaguacacaaacagcagaagauaaagaagaaccucuacauagcauaaucaguaguacagaaucuguacaaggaaguacaaguaaacacgaauuucaagccgaaacaaagaaacuccuugacaucguagcuagaagucuauauucagaaaaagaaguauucaucagggaauuaauuucaaaugcaucagaugccuuagaaaaacuaagacacaaacugguauccgauggacaagcccuaccagaaauggagauacauuuacaaacaaacgcagaaaaagguaccaucacaauccaggauacagguauaggcaugacucaagaagaacuuguuucuaaccuaggaacuauagcaagaucuggcaguaaagcauuccuagaugcuuuacaaaaccaagcagaagcaucuucaaaaauaauaggacaauuugguguaggauucuauagugcauuuaugguggcugaucguguagaaguuuauucacggucagcagcuccaggaucauuaggauaccaauggcuaucugaugguucaggagucuucgagauugcagaagcauccggaguaagaacaggcacaaaaaucauaauacaccuaaaaucugauugcaaagaauuuucuagcgaagcaagaguaagagauguagucacaaaauacuccaacuucgucucauucccacuauacuuaaauggcagacgaaugaauacucuacaagcuauauggaugauggauccaaaagauguccgggaauggcaacaugaagaguucuauagauacguugcucaagcucacgacaaaccacgauauacacuucauuacaaaaccgaugcaccacuuaauauaagaucaauauuuuauguaccagacaugaaaccaucuauguucgauguauccagagaauuaggaucaucuguagcauuauacucaagaaaaguguuaauacaaacuaaagcaacagauaucuuaccaaaauggcuucgauucauaagaggaguuguagauucagaagacaucccacuaaacuuaucgagagaauuacuacaagaaucagcacuuauuagaaaacuaagagauguccuacaacaaagauuaauaaaauucuuuauagaucaaucaaagaaagaugcagaaaaauacgcaaaauucuucgaagacuauggacuauuuaugagggaaggcauaguaacugcaacagaacaagaaguuaaagaagacauugcaaaacuacuaagauaugaaaguuccgcguuaccuucaggccaacucacgagucuaagcgaauaugcaagccgcaugcgugcaggaacuagaaacauauacuaccuaugugcgccuaacaggcaucucgcagaacauuccccuuacuacgaagcaaugaaaaagaaagauacagaaguacucuucugcuucgaacaauuugaugaacucacauuauuacaucuacgcgaguucgacaaaaagaaauuaauauccguagaaacagacaucgucguagaccacuauaaagaagaaaaauuugaagacagaucccccgcagcagaauguuuaagugaaaaagaaacagaagaauuaauggcauggaugagaaacguacuuggcucaagaguuacuaacguuaaaguaacucuacgacuagacacacauccugccaugguaacggucuuagaaaugggagcagcaagacacuuccuuagaaugcaacaauuagcaaaaacccaagaagaaagagcacaauuacuacaaccaacauuagaaaucaauccuaggcaugcauuaauaaagaaacuaaaccagcuuagagcaagcgaacccggucuugcacaacuauuaguagaucaaaucuaugaaaacgccaugauagcagcaggucuaguugacgaccccagagcaaugguagguagacuuaacgaacuacucgucaaagcauuagaaaggcauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3771 - RNA, 844 nt, Artificial Sequence
  mRNA product Design2 comprising derived and/or modified sequence from Homo sapiens__NP_000609.1__HsIGF1 (opt13)
ggggcgcugccuacggagguggcagccaucuccuucucggcaucaagcuuaccaugggaaaaauaucaucacuaccuacacaacuauucaaaugcugcuucugcgacuuccuaaaaguaaaaaugcacacaaugucauccucacaccuauucuaccuagcacuaugccuacuaacauucacaucaucagcaacagccggaccagaaacacuaugcggagcagaacuaguagacgcauuacaauucguaugcggagacagaggauucuacuucaacaaaccaacaggauacggaucaucaucaagaagagcaccacaaacaggaauaguagacgaaugcuguuucagaucaugcgacuuaagaagacuagaaauguacugcgcaccauuaaaaccagcaaaaagcgcaagaucaguaagagcacaaagacauacagacaugccaaaaacacaaaaagaaguacaccuaaaaaacgcaucaagaggaucagcaggaaacaaaaacuacagaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3772 - RNA, 925 nt, Artificial Sequence
  mRNA product Design2 comprising derived and/or modified sequence from Homo sapiens__NP_000603.1__HsIGF2 (opt13)
ggggcgcugccuacggagguggcagccaucuccuucucggcaucaagcuuaccaugggaauaccaaugggaaaaucaaugcuaguacuauuaacauuucuagccuucgcaucauguugcauagcagcauacagaccaagugaaacucuauguggaggagaauuaguagauacacuacaauuuguauguggagauagagguuucuauuucaguagaccagcaagcagaguaucaagaagaaguagaggaauaguagaagaaugcuguuucagaucaugugaccuagcacuacuagaaacauauugcgcaacaccagcaaaaucagaaagagauguaucaacaccaccaacaguauuaccagauaacuuuccaagauacccuguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccauuaauagcauuaccaacacaagauccagcacacggaggagcaccaccagaaauggcaucaaacagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3773 - RNA, 1021 nt, Artificial Sequence
  mRNA product Design2 comprising derived and/or modified sequence from Homo sapiens__NP_000591.1__HsIL6 (opt13)
ggggcgcugccuacggagguggcagccaucuccuucucggcaucaagcuuaccaugaacucauuuucaacaucagcauucggaccaguagcauucucacuaggauuacuacuaguacuaccagcagcauucccagccccaguaccacccggagaagacuccaaagacguagccgccccacacagacaaccacuaacaucauccgaaagaauagauaaacaaauaagauacauacuagacggaaucucagcacuaagaaaagaaacaugcaacaaaucaaacaugugcgaaucaucaaaagaagcacuagcagaaaacaauuuaaaccuaccaaaaauggcagaaaaagacggcugcuuccaaucaggauucaaugaagaaaccugccuaguaaaaauaauaacaggauuacucgaauucgaaguauacuuagaauaccuacaaaacagauucgaaucaucagaagaacaagcaagagcaguacaaaugagcacaaaaguacucauacaauuccuacaaaaaaaagcaaaaaaucuagacgcaauaacaacaccagacccaacaacaaacgcaucacuacuaacaaaacuacaagcacaaaaccaauggcuacaagacaugacaacucaccuaauacucagauccuucaaagaauuucuacaauccucacuaagagcacuaagacaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3774 - RNA, 1663 nt, Artificial Sequence
  mRNA product Design2 comprising derived and/or modified sequence from Homo sapiens__NP_002183.1__HsINHBA (opt13)
ggggcgcugccuacggagguggcagccaucuccuucucggcaucaagcuuaccaugccauuacuaugguuaagagguuuucuauuagcaucaugcuggauaauaguaagaucaaguccaacaccaggaagugaaggucauagugcagcaccugacuguccuaguugcgcauuagcagcauuaccaaaagacguaccaaacagccagccagaaaugguagaagcaguaaaaaaacauauauuaaauaugcuacaucuaaaaaaaaggccagacguaacacaaccaguaccaaaagcggcuuuauuaaaugcaauaagaaaauuacauguagguaaaguaggagaaaacgguuacguagaaauagaggaugacauaggccgaagagcagaaaugaaugaacuaauggaacaaacaagugaaauaauaacauuugcagaaucaggaacagcaagaaaaacgcuacacuucgaaauaagcaaagaaggaagcgaucuuagugugguagaaagagcagaaguaugguuauuccugaagguacccaaagccaaucgaacgagaacaaaaguaacaauaagauuauuucaacaacaaaaacauccacaagguucacuagauacaggagaggaagccgaagaaguagguuuaaaaggagaaagaucugaauuauuauuguccgaaaaaguaguagaugccagaaaaaguaccuggcauguauuuccagugaguucaucaauacaaagauuacuagaucaagguaaaucaucacuagauguaagaauagcaugugaacaaugucaagaaaguggagcuaguuuaguacuauuaggaaagaaaaaaaaaaaggaggaagaaggagaaggaaaaaaaaaaggaggaggagaaggaggagcgggagcagaugaagaaaaagaacaaagucauagaccauucuuaauguuacaagcaagacaaagcgaagaucauccacacagaagaagacgacgaggacuagaaugcgauggaaaagucaauauauguuguaaaaaacaauuuuuuguaucauuuaaagacauaggauggaacgauuggauaauagcgccaucaggauaucacgcuaacuauugugaaggagaauguccaagccauauagcaggaacgaguggaagcucauuaucauuucacagcacgguaauaaaccauuauagaaugagaggacauagcccauuugcaaauuuaaaaucauguuguguaccuacaaaacuacguccaaugagcaugcuauauuacgacgacggacaaaauauuauaaagaaagauauccaaaauaugauaguagaagagugcggauguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3775 - RNA, 1606 nt, Artificial Sequence
  mRNA product Design2 comprising derived and/or modified sequence from Homo sapiens__NP_002184.2__HsINHBB (opt13)
ggggcgcugccuacggagguggcagccaucuccuucucggcaucaagcuuaccauggauggauuaccagggagagcauuaggagcagcaugucuauuauuauuagcagcagguugguuaggcccagaagcauggggaucuccaacaccaccaccaacaccagcagcacccccaccaccaccaccaccaggaaguccaggaggaagccaagauacauguacaagcugugguggauuuagaagaccagaagaauuaggaagaguagauggagacuuuuuagaagccguaaaaagacacauacuuucaagauuacaaaugagaggaaggccaaauauaacacaugcaguaccaaaggcagcaaugguuacagcauuaagaaaauuacacgcaggaaaaguaagagaagaugguagaguagaaauaccacauuuagacgggcacgcaucaccaggugcagaugggcaagaaagaguaagugagauaauuagcuuugcagaaacagauggauuagcaucaucaagaguacgauuauauuucuuuauaaguaacgaaggaaaucaaaaucuauucguagugcaagcaucacuaugguuauauuuaaaauuauugccauauguacuagaaaaaggaagcagaagaaagguaagaguuaaaguuuauuuucaagaacaaggucauggagaucgauggaauaugguagaaaaacgaguagauuuaaaaagaucaggauggcauacauuuccacuaacagaagcaauacaagcauuauucgaaagaggcgaaagaagacugaauuuagacgugcaaugugacucaugccaagaauuagcagugguuccagucuuuguagacccaggagaagaaagccauagaccauuuguaguaguacaagcaagacuaggagauaguagacauagaauaagaaaaagagguuuagaaugugacggaagaacaaauuuauguugcagacaacaauucuuuauugauuuuagguuaauagguuggaaugauuggauaauagcaccaacaggauauuauggaaauuauugugaaggaagcuguccagcauauuuagcugguguaccagguucagcuaguaguuuucacacagcaguagucaaucaauaucguaugcgaggauuaaauccugguacuguaaauagcuguuguauaccaacaaaacuaaguacaaugucaauguuauauuuugaugaugaauauaauauaguuaaaagagauguuccaaauaugauaguagaagaauguggaugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3776 - RNA, 3841 nt, Artificial Sequence
  mRNA product Design2 comprising derived and/or modified sequence from Homo sapiens__NP_000623.2__HsITGAM (opt13)
ggggcgcugccuacggagguggcagccaucuccuucucggcaucaagcuuaccauggcauuacgagucuuacuuuuaacagcauuaacucugugccacggauuuaaucuugauacagaaaaugcaaugacauuucaagaaaacgcacgaggauuuggccagucgguaguacaguuacaggguagcaggguuguugucggugccccacaagaaauaguagcagccaaucaaagagguucacuauaccaaugugauuacucuacaggaaguugugagcccauaagauuacaaguacccgucgaagcagucaauaugucccuaggacuaaguuuagcagcaacaacuagcccaccacaauuacuagcuugcggcccaaccguacaccagacauguucugaaaauaccuaugucaaagguuuaugcuucuuauucgguaguaauuuaagacagcaaccacaaaaauuuccugaagcacuacgcggauguccucaagaagacuccgacauagcauuucuaauagacggaaguggcaguauaauaccccaugacuuuaggagaaugaaagaauuuguguccacaguaauggaacaacuaaagaaaucuaagacacuuuucucauuaaugcaauauagugaagaauuuagaauacauuucaccuucaaagaauuucaaaacaacccgaauccaagaucccuaguuaaaccaauaacccaguuacuaggaagaacacauacugccacaggcauucgaaaaguaguacgagaacuauuuaacauuacuaauggagcuagaaagaacgcuuucaaaauucuaguaguuauaacugauggagagaaauucggagacccucuuggauacgaagauguuauaccagaagccgauagagaaggagucauaagauauguaauaggaguaggcgaugccuuccgaagcgaaaaauccagacaggaacuaaauacaauagcuagcaaaccaccgagggaccacguuuuucaagucaauaauuuugaagcauuaaaaaccauucaaaaccaacuaagggagaaaauauucgcuauagaaggaacacaaaccggaucuaguaguagcuuugaacaugaaaugucccaagaagguuuuucugcugcgauaacuucaaauggcccacuacuaucaacagucgguaguuaugauugggccggaggaguauuccuuuauacaaguaaagaaaaaucaacauucauaaauaugacaagaguagacucugauaugaaugaugccuauuuaggauacgcagcagcaaucauacuacgcaacagaguccaaucacucguacuaggugcccccagauaccaacauaucggucuggucgcuauguuucgucaaaauacagguaugugggaaaguaaugcaaauguaaaagguacucaaauaggcgcauauuuuggugcuucauuaugcagcguugacguggauucgaacgguaguacagacuuaguguuaauaggcgcaccccacuacuacgaacaaacaagaggugggcagguaucaguaugcccucuacccagaggccgugccagauggcaaugugacgcaguacuauauggagaacaagggcaaccaugggguagauuuggggcugcauugacaguuuuaggagacguaaauggagauaaacuaacggauguugcuauaggagccccuggugaggaagauaauagaggagcgguauaccuauuucauggaacaucuggaaguggaauuucaccuagucacucacaaaggauagcaggauccaagcucuccccacgauuacaauauuuuggacagagccuaucgggaggucaagaucuaacuauggaugguuugguggaucucaccguaggcgcucaaggucaugugcuacuauuacgaucacaaccuguacuuagaguaaaagccauaauggaguucaacccaagagaaguagcucguaauguauucgaaugcaacgaucaaguuguaaaaggcaaagaagcaggagaagugcgugucugucuucauguucagaaaagcacacgugaucgauuaagagagggccaaauucaaucuguaguuacauacgacuuagccuuagacuccggacgaccacacucucgcgcagucuuuaaugaaacgaaaaacucaacacgaaggcaaacacaaguacuaggauuaacucaaacaugcgaaacccuuaaacuacaauuaccuaacuguaucgaagacccaguaucuccaaucguauugagacuaaauuuuuccuuaguaggcacaccacuuagugcuuuuggaaaucuaagaccggucuuagcagaagaugcucaaagauuauuuaccgcacuguucccauucgagaaaaacuguggaaacgauaauauaugccaagacgacuuaucuauuacauucucauucaugucguuagauugucuaguaguaggaggacccagagaauuuaauguaaccgucacaguucgaaaugacggagaagacucauauagaacccaaguaacauucuucuuuccguuagaucucagcuaucggaaaguaucaacauuacaaaaccaacgaagccaacgaucauggaggcucgcaugugaaagcgcuuccaguacggaaguaaguggagcacucaaaucuacaucuugcucuauuaaccacccaauauuuccggaaaacagugaggucacuuuuaauaucaccuucgacguagauagcaaagccaguuuaggaaauaaacuucuucucaaggcaaacguaacuucugaaaauaauaugccaagaaccaacaaaacagaguuccaacuagaauuaccagucaaauacgcaguauauaugguaguaacaagucauggaguuuccacgaaauaccuaaacuuuacugcaucagaaaacacaagcagaguaaugcaacaucaauaccaaguaucaaauuuaggacaacgaaguuuaccaauaucguuaguuuuccuggucccagucagauugaaucaaacaguaaucugggauagaccacaaguaacauuuucagaaaaucucucaucaaccugucauaccaaggaaagauuaccuucacauucagauuuucuagcagaacuacgcaaagcuccaguaguuaauugcucaaucgcaguaugucaaagaauacaaugugacaucccauucuuuggcauucaagaagaauuuaacgcuacauuaaaaggaaaucuuaguuuugauugguacaucaaaaccagucauaaccauuuacuaauagucucuacugcugaaauacuauuuaaugauucuguauuuacucuauuaccaggacaaggagcuuuuguucgaucacaaacagaaacuaaaguagaaccauucgaagucccaaauccauuaccauuaaucguggguucuucuguaggcggcuuauuacuuuuagcauuaauaacugcugccuuguauaaauuaggauuuuucaaaaggcaauauaaagauaugaugucugaaggagguccacccggagccgaaccacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3777 - RNA, 1786 nt, Artificial Sequence
  mRNA product Design2 comprising derived and/or modified sequence from Homo sapiens__NP_002415.1__HsMMP8 (opt13)
ggggcgcugccuacggagguggcagccaucuccuucucggcaucaagcuuaccauguucucccucaaaacacuaccauucuuacuacuacuccauguacaaauauccaaagcauucccuguaucaucaaaagaaaaaaacacaaaaacaguacaagacuaccuagaaaaauucuaccaauuaccuucaaaccaauaccaaucaacaagaaaaaacggaacaaacguuauaguagaaaaacuaaaagaaaugcaacguuucuuugguuuaaauguaacagguaaaccaaacgaagaaacauuagacaugaugaaaaaaccaagauguggaguaccagacuccggcggauuuauguuaacaccaggaaauccaaaaugggaaagaacaaauuuaacuuaccgaauaagaaacuacacaccucaauuaagcgaagcagaaguagaaagagcaauaaaagaugccuucgaacuaugguccguagcaucaccucuaauuuucacaagaauaucacaaggagaagcagacaucaacauagcuuuuuaucaaagagaucacggagacaauucaccauuugauggaccaaacggaauccuagcacaugcauuucaacccggucaaggaauaggaggagacgcacacuucgaugccgaagaaacauggaccaacacuucagcaaacuacaaccuauuucuaguagcagcacaugaauucggccacucauuaggacucgcucauuccucagacccuggagcccuaauguaucccaacuaugcauucagagaaacaucaaacuauucacuaccucaagacgacauagauggaauucaagcuaucuacggauuaucaucaaacccaauucaaccaacaggaccaucaacacccaaaccuugugacccaucccuaacauuugacgcuauaacaacacuaagaggagaaauauuauucuucaaagacagauacuuuuggagaagacacccucaacuacaaagaguugaaaugaacuuuauaucauuauucuggccaucacuaccaacaggaauacaagcagcauacgaagacuucgauagagacuuaauauuccuuuucaaaggaaaccaauacugggcccuaaguggauacgacauauuacaagguuauccuaaagacauaucaaacuacggauuuccaucuucaguacaagcaauagacgcagcagucuucuauagaucaaaaacauacuuuuucguaaacgaccaauucuggagauaugacaaccaacgacaauuuauggaaccaggauauccaaaaucaauaucaggagcauucccuggaauagaauccaaaguagacgcaguauuucaacaagaacacuucuuccauguuuuuucaggaccaagauacuacgcuuuugacuuaauagcacaaagaguaacaagaguagcaagaggaaacaaauggcuaaacugccgauauggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3778 - RNA, 2506 nt, Artificial Sequence
  mRNA product Design2 comprising derived and/or modified sequence from Homo sapiens__NP_004985.2__HsMMP9 (opt13)
ggggcgcugccuacggagguggcagccaucuccuucucggcaucaagcuuaccaugucauuauggcaaccauuaguuuugguacuuuuaguauuaggauguuguuuugcugcaccacgucaaagacaaaguacauuaguccuauuuccaggcgauuuaagaacaaauuuaacagacagacaacuugcagaagaauaucuauauagauaugguuauacaagaguagcugaaaugagaggugaaucaaaaucucuaggaccagcauuauuacuacuacaaaaacaguuaucacuaccagaaaccggggaacuagacucagcuacacuuaaagcaaugagaacuccacgguguggagucccagaucucggucgguuucaaacauuugaaggagaccuuaaauggcaucaucacaauauaacauauuggauacagaauuauucagaagaccuaccaagagcgguuauagacgacgcauucgcccgagcauuugcacuauggagugcuguaacaccauugacuuuuacaaggguauauagucgagaugcagauaucguaauacaauuugguguagcagagcauggggauggauacccuuuugacgguaaagacggacuucuagcacaugcauuuccaccaggaccuggaauacaaggagaugcccauuuugaugacgacgaacuauggagucuuggaaaaggagucguaguaccuacaagauuugguaaugcugauggugcagcaugucauuuuccuuuuauauuugaaggacgaucuuacucugcaugcacuacagauggacguucagauggauuaccaugguguucuacuacagccaauuaugauacagaugauagauuugguuuuuguccuucagaacgauuauauacgcaagauggaaaugcagauggaaaaccuugucaauucccauuuauauuucaaggacaaucauauucagcauguacaacagauggacgaagcgauggauaucgauggugugcaacaacagcuaacuacgacagagauaaauuauuugguuuuuguccaacucgcgcugacucaacagucaugggugguaauagcgcuggugaauuauguguauuuccauuuacuuuccuuggcaaagaauacucaacaugcacaucggaaggaagaggagauggacgauuauggugugcaacuacuaguaauuucgacagugacaaaaaauggggauuuuguccggaccaaggguauucacuuuucuuaguugcagcacacgaauucggucaugcacuuggccuagaccauucaucaguaccugaagcucuuauguacccaauguauagauuuacagaaggaccuccacuccauaaagacgaugucaacggcauacgccaucuauaugguccacguccagagccugaaccaaggccucccacaacaacaacaccacaaccuacugcuccaccuacaguaugcccgacuggcccaccaacaguacauccaucugaaagaccaacggccggaccaacgggaccuccuucagcggguccaacaggaccaccaacagcaggccccagcacugccacuacaguaccauuaucaccuguggacgaugcuuguaauguuaauauauuugaugcaauagcugaaauugguaaucaacuguauuuauuuaaagauggaaaauauuggcgauuuagugaaggacgcggaucuagaccccaaggaccauuucuaauugccgauaaauggccagcccuaccuagaaaauuagauucuguauuugaagaaagauuaucaaaaaaauuauuuuuuuucucaggaagacaaguauggguuuauacaggagcaucaguacuaggaccuagaagacuagauaaacuagguuuaggagccgacgucgcacaaguuacaggcgcccuaagaucaggaagaggaaaaauguuauuauucagcgguagaagauuauggagauuugaugugaaagcacaaaugguugauccaagaucagcuagcgaagucgaucgaauguucccagguguaccauuggauacucaugauguuuuucaauauagagaaaaagcauauuuuugucaagauagauuuuauuggcguguuucaucuaggagugaauuaaaccaaguggaucaaguaggauauguaacauacgauauacuacaauguccagaagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3779 - RNA, 1798 nt, Artificial Sequence
  mRNA product Design2 comprising derived and/or modified sequence from Homo sapiens__NP_002418.1__HsMMP13 (opt13)
ggggcgcugccuacggagguggcagccaucuccuucucggcaucaagcuuaccaugcacccaggaguauuagcagcauuccucuucuuaucauggacacacugccgagcauuaccauuaccaucaggaggagacgaagacgaucuaucagaagaagaccuucaauucgcagaaagauacuuaagaucauacuaccacccaacaaacuuagcagguauacuaaaagaaaacgcagccucuucaaugacagaaagacuuagagaaaugcaaucauucuucggauuagaaguaacaggaaaauuagaugacaauacacuagauguaaugaaaaaaccuagaugcggaguuccugacguaggagaauauaacgucuuuccaagaacauuaaaaugguccaaaaugaaccuaacauauagaauaguaaacuauacaccagauaugacccauucagaagucgaaaaagcauucaaaaaagcauucaaaguauggucagauguaacaccucuaaacuucacaagacuacaugacggaauagcagacaucaugauaagcuuuggaauaaaagaacacggagauuucuacccauucgacggaccaucuggauuauuagcccacgcauuucccccaggaccaaauuauggaggagacgcacauuucgaugacgaugaaacauggacaucaucaucaaaaggauacaaccuauucuuaguagcagcacacgaauucggacacucuuuaggcuuagaccauucaaaagaccccggagcacuaauguucccaauauauacauauacaggaaaaagccacuucauguuaccagacgaugacguccaagguauacaaagucuauacggaccaggagaugaagauccuaacccaaaacauccaaaaaccccagacaaaugugauccaucauuaucauuagaugccauaacaucauuacgaggagaaacaaugauuuucaaagaccguuucuucuggcgucuucacccacaacaagucgacgcagaacucuuuuuaacaaaaucguuuuggccugaacuaccaaacagaauagaugcagcauacgaacacccuagucacgacuuaauauuuauuuuucgaggacgaaaauucugggcccuaaauggauacgauauauuagaaggauacccuaaaaaaauaucugaacuaggauuaccaaaagaaguaaaaaaaauaucagccgcaguccacuuugaagauacaggaaaaacacuucuauuuucaggcaaucaagucuggagauacgacgacacaaaccacauaauggacaaagacuaccccagauuaauagaagaagacuucccaggcauaggugacaaaguagacgcaguauacgaaaaaaacggauauauauauuucuucaacggaccaauacaauuugaauacucuauauggucaaacagaauaguaagaguaaugccagcaaacuccauuuuauggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3780 - RNA, 1450 nt, Artificial Sequence
  mRNA product Design2 comprising derived and/or modified sequence from Homo sapiens__NP_001286.1__HsCCR1 (opt13)
ggggcgcugccuacggagguggcagccaucuccuucucggcaucaagcuuaccauggaaacaccaaacacaacagaagacuacgauacaaccacagaauuugauuauggagacgcaacaccaugucaaaaaguaaacgaaagagccuuuggcgcgcaacuacuacccccauuauacucacuagucuucgucauaggacuaguagguaauauacuaguaguacuaguauuaguccaauacaaaagauuaaaaaauaugacaucaauauauuuacuaaacuuagcaauaucagauuuacuauuccuauucacauuaccauucuggaucgacuacaaacuaaaagacgacuggguauuuggagacgcaaugugcaaaauacucucaggauucuacuacacaggccuauacucugaaaucuucuucauaauacuacuaacaauagauagauaccuagcaauaguucaugcaguauucgcauuaagagccagaaccgucacauucggagucauaacaucaauaauaauaugggccuuagcaauauuagcaucaaugccaggacuauacuuuucuaaaacacaaugggaauucacacaucauacaugcucacuucacuucccucacgaaucccuaagagaauggaaacucuuccaagcauuaaaacucaaucuuuucggacuaguacuaccccuacucguaaugaucauaugcuacacaggaauaauaaaaauacuacuacgacgaccaaacgaaaaaaaaucaaaagcaguaagauuaauauucguaauaaugaucaucuucuuccuuuuuuggaccccuuacaaccucacaauacuaauaucaguauuccaagacuuuuuauucacacacgaaugugaacaauccagacaucucgacuuagcaguacaagucaccgaaguaauagcauacacacacuguugcguuaaccccguaauauacgcuuuuguaggagaaagauuccgaaaauaucuaagacaacuauuucacagacgaguugcaguacacuuagucaaaugguuaccauuucuaucaguagauagauuagaaagagucucauccacaucaccaucaaccggagaacacgaauuaucagcaggauucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3781 - RNA, 1018 nt, Artificial Sequence
  mRNA product Design2 comprising derived and/or modified sequence from Homo sapiens__NP_002598.4__HsPDGFA (opt13)
ggggcgcugccuacggagguggcagccaucuccuucucggcaucaagcuuaccaugagaacacuagcaugccuacuauuacuaggaugcggauaccuagcacauguacuagcugaagaagcagaaauaccaagagaaguaauagaaagacuagcaagaucacaaauacacucaauaagagaccuacaacgacuacuagaaauagacucagucggaagugaagacucacucgacacaagucuaagagcacacggaguacacgcaacaaaacacguaccagaaaaaagaccacuacccauaagaagaaaaagaagcauagaagaagcaguaccagcaguaugcaaaacacgaacaguaauauacgaaauaccaagaucacaaguagacccaacaucagcaaacuuccuaauauggcccccaugcguagaaguaaaaagaugcacaggaugcugcaacacaucaagcguaaaaugccaaccaagcaggguacaccacagaagcgucaaaguagcaaaaguagaauacguaagaaaaaaaccaaaacuaaaagaaguacaaguaagacuagaagaacaccuagaaugcgcaugugcaacaacaagccuaaauccagauuacagagaagaagacacaggaagaccaagagaaagcggaaaaaaaagaaaaagaaaaagacuaaaaccaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3782 - RNA, 1108 nt, Artificial Sequence
  mRNA product Design2 comprising derived and/or modified sequence from Homo sapiens__NP_002599.1__HsPDGFB (opt13)
ggggcgcugccuacggagguggcagccaucuccuucucggcaucaagcuuaccaugaacagaugcugggcauuauucuuaucauuaugcuguuaccuaagauuaguaucagcagaaggagauccaauaccagaagaacuauacgaaaugcuaagcgaucacaguauaagaagcuuugacgaucuacaaagauuacuucacggcgauccaggagaagaagacggagcagaauuagaccuaaauaugacaagaucacacucaggaggagaauuagaaucacuagcacguggaagaagaagccuaggaagucuaacaauagcagaaccugcaaugauagcagaauguaaaacacgaacagaaguauucgaaauaucaagaagauuaauagauagaacaaaugcaaauuucuuaguauggccaccauguguagaaguacaaagaugcaguggaugcugcaauaacagaaacguacaauguagaccaacacaaguacaauuaagaccaguacaaguaagaaaaauagaaauaguaagaaaaaaaccaauauuuaaaaaagcaacagucacauuagaggaccaccucgcaugcaaaugugaaaccguagcagcagcaagaccaguaacaagaagcccaggcggaagccaagaacaaagagcaaaaacaccacaaacuagaguuacaauaagaacaguaagaguacgaaggcccccaaaaggaaaacauagaaaauucaaacacacacacgacaaaacagcacuaaaagaaacacuaggagcguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3783 - RNA, 1420 nt, Artificial Sequence
  mRNA product Design2 comprising derived and/or modified sequence from Homo sapiens__NP_057289.1__HsPDGFC (opt13)
ggggcgcugccuacggagguggcagccaucuccuucucggcaucaagcuuaccaugucauuauuuggauuauuacuacuuacaucagcauuagcaggacaaagacaagguacacaagcagaaagcaaucuaucaagcaaauuccaauuuucauccaauaaagaacaaaauggaguacaagacccacaacacgaaagaauaauaaccgucagcacaaacggcucaauacauaguccacgauucccacauacauauccaagaaacaccguacucgucuggagauuaguagcaguugaagaaaauguauggauccaauuaacauucgacgaaagauuuggauuagaagacccugaagacgacauaugcaaauacgacuuuguagaaguagaagaaccaucagacggaacaauauuaggacgauggugcggaucagguacaguaccugguaaacaaaucucaaaaggcaaccaaauaagaauaagauucguaagcgaugaauacuucccaagugaaccaggauucuguauacauuacaauaucgucaugccacaauucacagaagcaguaucaccaucaguacuaccaccaucagcucuaccauuagacuuacuaaauaacgcuauaacagcauuuucaacauuagaagacuuaauacgauacuuagaaccagaaagauggcaacuagaccuagaagaccuauacaggccaacauggcaacuucuaggaaaagcauuuguauuuggaagaaaaucacgaguugucgaucuaaaccuauuaacagaagaaguaagacuuuacucaugcacaccaagaaacuuuucaguauccauaagagaagaacuaaaaagaacagauacaauauucuggccaggaugccuacuaguaaaaagaugcggcggaaauugcgcaugcugcuuacacaacuguaacgaaugccaaugcguaccaucaaaaguuacaaaaaaauaccacgaaguacuacaauuaagacccaaaacuggaguuagaggacuacauaaaucucuaacagacguagcacuagaacaucacgaagaaugugacugcguuugccgaggaagcacaggaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3784 - RNA, 1477 nt, Artificial Sequence
  mRNA product Design2 comprising derived and/or modified sequence from Homo sapiens__NP_149126.1__HsPDGFD (opt13)
ggggcgcugccuacggagguggcagccaucuccuucucggcaucaagcuuaccaugcacagauuaauauuuguauacacacuaauaugugcaaacuucugcucaugcagagacacauccgcaacuccacaaucagcaucaauaaaagcuuuaagaaacgcaaaucuaagaagagacgaucuauacagaagagacgaaaccauacaaguaaaaggaaacggcuacguacaaagcccacgauucccuaacucauacccaagaaaucuauuauuaacauggcgacuacacucccaagaaaacacaagaauacaacuaguauucgauaaccaauucggauuagaagaagcagaaaacgacauauguagauaugauuucguagaaguagaagacauaucagaaacaucaacuauaauacgaggaagauggugcggacacaaagaaguaccaccacgaauaaaaucaagaacaaaccaaauaaaaauaacuuucaaaucagaugacuacuucguugcaaaacccggauucaaaauauauuauagccuacuagaagacuuccaaccagcagcagcuucagaaacaaauugggaaucagucacaagcucaauaucaggaguaucauauaauagcccaucaguuacagacccaacacuaaucgccgacgcauuagacaaaaaaauagcagaauucgauacaguagaagaucuacuaaaauacuuuaacccugaaucauggcaagaagaucuagaaaacauguaucuagacacacccagauacagaggaagaagcuaccacgacagaaaaucaaaaguagacuuagacagacuaaaugaugacgcaaaaagauacucaugcacaccaagaaacuacagcguaaauauaagagaagaacuaaaauuagcaaacguaguauucuucccaagaugucuauuaguacaacgcugcggaggaaacuguggaugcggaacaguaaacuggcgaagcuguacaugcaauuccggaaaaacagucaaaaaauaccacgaaguacuacaauucgaacccggacauauaaaaagaagagguagagcaaaaacaauggcacuaguagauauacaauuagaccaccaugaaagaugcgauuguauaugcagcucuagaccuccaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3785 - RNA, 1060 nt, Artificial Sequence
  mRNA product Design2 comprising derived and/or modified sequence from Homo sapiens__NP_003946.3__HsSOCS3 (opt13)
ggggcgcugccuacggagguggcagccaucuccuucucggcaucaagcuuaccauggucacccauucaaaauucccagcagcaggaaugucaagaccauuagacacaucauuacgauuaaaaacauucucaucaaaaucagaauaccaacuaguaguaaaugcaguaagaaaacuacaagaaucaggauucuauuggucagcaguaacaggaggagaagcaaauuuauuacuaucagcagaaccagcaggaacuuuccuaauacgagacucaucagaccaacgacacuucuuuacucuaucaguaaaaacacaaucaggaacaaaaaaccucagaauacaaugugaaggaggaucauucucccuacaaucagaccccagaucaacacaacccguaccaagauucgacugcguacuaaaacuaguacaccacuacaugccaccacccggagcaccauccuucccaucuccaccaacagaaccaucaucugaaguaccugaacaaccaucagcacaaccacuaccuggaucaccaccaagaagagcauacuacauauacucaggaggagaaaaaauaccacuaguacuuucaagaccacuaucaucuaauguagcaacacuacaacacuuaugccgaaaaacaguaaacggccaccuagacucauacgaaaaagucacacaacuaccaggaccaauaagagaauucuuagaucaauacgacgcaccacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3786 - RNA, 865 nt, Artificial Sequence
  mRNA product Design2 comprising derived and/or modified sequence from Homo sapiens__NP_003227.1__HsTGFA (opt13)
ggggcgcugccuacggagguggcagccaucuccuucucggcaucaagcuuaccaugguaccaucagcaggacaauuagcauuauuugcacuaggaauaguacuagcagcaugucaagcauuagaaaacucaacaucaccacuaucagcagacccaccaguagcagcagcaguaguaucacauuuuaaugauugcccagacucacacacacaauucugcuuucacggaacauguagauuucuaguacaagaagacaaaccagcauguguaugucauucaggauauguaggagcaagaugugaacaugcagauuuauuagcaguaguagcagcaucacaaaaaaaacaagcaauaacugcauuaguaguaguaaguauaguagcauuagcaguauuaauaauaacauguguauuaauacauugcugucaaguaagaaaacauugugaauggugcagagcauuaauauguagacaugaaaaaccuucagcauuacuaaaaggaagaacagcaugcugucacucagaaacaguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3787 - RNA, 1555 nt, Artificial Sequence
  mRNA product Design2 comprising derived and/or modified sequence from Homo sapiens__NP_000651.3__HsTGFB1 (opt13)
ggggcgcugccuacggagguggcagccaucuccuucucggcaucaagcuuaccaugccaccaucaggucuacgacuacuaccucucuuacuaccuuuacuauggcuccucguacuaaccccaggccgaccagcagcuggccuaucaacaugcaaaacaauagacauggaauuagucaaaagaaaaagaauagaagcaauuagaggacaaauacuaucaaaauuaagauuagccuccccaccuucucaaggagaaguaccaccagguccacuaccugaagcaguccuagcacuauacaacucaacaagagacagaguagcaggagaauccgcagaaccagaacccgaaccagaagcagacuauuaugcaaaagaagucaccagaguacuaaugguagaaacacauaaugaaaucuacgauaaauuuaaacaaucaacacauucaauauacauguuuuucaacacaagugaacuaagagaagcaguaccagaaccaguauuacuaucacgagccgaauuaagacuccuaagacuuaaacuaaaaguagaacaacacguugaauuauaccaaaaauacucuaacaacucauggagauacuuaucuaaucgacuacuagcacccucagacucaccagaauggcucucauucgacguaaccggaguaguacgacaauggcuaucccguggcggugaaauagaaggauucagacuauccgcacacugcucuugcgacucaagagacaauacauuacaaguagauauaaacggauucacaacaggaagaagaggagacuuagcuacaauccacggaaugaaccgccccuuccuacuauuaauggcaacuccucuagaaagagcacaacacuuacaauccucaagacacagaagagcacuagacacaaacuauuguuucucaagcacugaaaaaaacugcugcguccgacaauuauacauagacuuccgaaaagaucucggauggaaauggauacacgaaccaaaaggauaccacgccaacuucugccucgguccauguccauauaucuggucacuagauacacaauacuccaaaguacuagcauuauauaaccaacauaauccaggagcaucagcagcgccaugcugcguaccacaagcauuagaaccacucccaauaguauacuaugucggaagaaaaccaaaaguagaacaacuaucaaacaugauagucagaucaugcaaauguucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3788 - RNA, 1627 nt, Artificial Sequence
  mRNA product Design2 comprising derived and/or modified sequence from Homo sapiens__NP_003229.1__HsTGFB2 (opt13)
ggggcgcugccuacggagguggcagccaucuccuucucggcaucaagcuuaccaugcacuauugcguacuuucagcauuucuaauauuacaccuaguaacagucgcuuuaaguuuaagcacaugcucaaccuuagacauggaccaauuuaugagaaaacgaauagaagcaauaagaggacaaauauuauccaaacuaaaacuaacaucaccacccgaagauuauccagaaccagaagaagucccaccagaaguaauaucaauauauaacagcacaagagaccuccuacaagaaaaagcaucaagaagagcagcagcaugcgaacgagaaagaucagaugaagaauauuacgcuaaagaaguauacaaaauagacaugccccccuucuuuccaucagaaaaugcaauaccaccaaccuuuuacagacccuauuuucgaauaguaagauucgauguaucagccauggaaaaaaacgcaucaaaccuagucaaagcggaauucagaguauuccgacuucaaaacccaaaagcuagaguucccgaacaacgaaucgaacuauaucaaauacuaaaaucaaaagaccuaaccucacccacacaaagauacauagacucaaaaguaguaaaaaccagagcagagggcgaaugguuaucauucgacguaacagacgcaguacacgaauggcuacaucacaaagaccgaaaucucggauucaaaauaucacuacacugcccaugcugcacauucgucccaucaaacaacuauauaauaccaaauaaaucagaagaacuugaagcaagauuugcuggaauagacggaacaaguacauacaccucuggagaccaaaaaacuauaaaaucaacaagaaaaaaaaacucuggcaaaacaccucaccuacuauuaaugcuacuacccucauacagacuagaaucacaacaaacaaaccgaagaaaaaaaagagcacuagacgcagcauacuguuucagaaacguacaagauaacugcugccucagaccacuauauauagacuucaaaagagaccuaggauggaaauggauacaugaaccaaaaggcuacaacgccaacuucugcgcaggagcaugcccauacuuauggucaucugacacacagcacucaagaguacuaucacuauacaacacaauaaauccagaagcuucagcaagucccugcugcguaucacaagacuuagaacccuuaacuauauuauauuauaucggaaaaacaccaaaaauagaacaacuaucaaacaugauaguaaaaucauguaaauguaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3789 - RNA, 1621 nt, Artificial Sequence
  mRNA product Design2 comprising derived and/or modified sequence from Homo sapiens__NP_003230.1__HsTGFB3 (opt13)
ggggcgcugccuacggagguggcagccaucuccuucucggcaucaagcuuaccaugaaaaugcaccuccaaagagcccucgucguucucgcacuacuaaacuucgcaaccguaucacuaucccuaucaacaugcacaacccuagacuucggacacauaaaaaaaaaaagaguagaagcaauccgaggccaaauuuuaucaaaacuaagacuaacaucaccaccagaacccacagucaugacacacguaccauaccaaguccuagcacuauacaacucaacacgagaacuauuagaagaaaugcacggagaaagagaagaaggauguacacaagaaaacacugaaagugaauacuaugcaaaagaaauacacaaauucgauaugauacaaggacuagcagaacacaacgaacuagcaguaugcccaaaaggaauaacaucaaaaguauuucgauucaacguaucaucaguagagaaaaaucgaacaaaccuauuuagagccgaauuuagaguccuaagaguccccaauccaucaucaaaaagaaacgaacaacgcauagaacuauuucaaauacuacgcccagacgaacacauagcaaaacaaagauacauagguggaaaaaaccucccaaccagaggaacagccgaauggcuaucauucgacguaacagacaccgucagagaauggcuacuccgcagagaaucaaacuuaggucuagaaauaucaauacacugcccaugccauacauuucaaccaaauggagacauauuagaaaacauacaugaaguaauggaaaucaaauucaaaggaguagacaacgaagacgaccacggacgaggcgaccucggcagacuaaaaaaacaaaaagaucaccacaauccacaccuaauccuaaugaugauacccccccacagacuagacaacccaggacaaggaggacaacgaaaaaaaagagcacucgacacaaauuauuguuuccgaaaucuagaagaaaacugcugcguccguccacuuuacauagacuucagacaagaccuaggauggaaauggguucacgaaccaaaaggauauuaugccaacuucugcucaggacccugcccauacuuaagaucagcagacacaacacacucuacaguacuaggacuauacaacacacuaaacccagaagccucagcaucacccugcugugucccacaagaccuagaaccuuuaaccauacuauacuacguaggaagaacuccuaaaguagaacaacuuucaaauaugguaguaaaaucaugcaaaugcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3790 - RNA, 1768 nt, Artificial Sequence
  mRNA product Design2 comprising derived and/or modified sequence from Homo sapiens__NP_001057.1__HsTNFRSF1B (opt13)
ggggcgcugccuacggagguggcagccaucuccuucucggcaucaagcuuaccauggcaccaguagcaguaugggcagcacuugcaguaggacucgaauuaugggcagcagcacaugcauuaccugcacaaguugcauucacacccuacgcacccgaaccaggcucaaccuguagauuaagagaauauuacgaucaaacagcucaaaugugcuguucuaaaugcucaccuggccaacaugcaaaaguauuuugcacuaaaacaucugauaccguaugugauucuugugaagacucaacauauacacaacuauggaacuggguuccagaaugucuaucaugcggaucaagauguucaucagaccaaguugaaacacaagcauguacucgugaacaaaaucgaauuugcacauguagaccaggaugguauugcgcuuuaucgaaacaagaaggauguagacuaugcgcaccucuuagaaaaugcagaccaggcuuuggagucgcucgacccggaacugaaacaucagacguaguaugcaaaccuugugcaccagguacauucucuaacacaacaaguucaacagauauuuguagaccacaccaaauauguaacguaguugcuauaccaggaaacgcaucuauggaugcaguauguacaucuacgucaccuaccagaucaauggcaccaggagcaguucacuuaccacaaccaguaucaacaagaagucaacacacacaaccaacaccugaacccucaacugcaccaagcacuucauuucuacuaccaaugggucccucaccaccugcugaaggaucaacaggagacuucgcauuaccugucggacuuaucguaggaguuacagcauuaggacuauuaauaaucgguguaguaaauuguguuauuaugacacaaguaaaaaaaaaacccuuauguuuacaaagagaagccaaaguaccucauuuaccagcagauaaagccagaggaacccaagguccagaacaacaacauuuauuaaucacagcucccucaucaucaucaucaucuuuagaaucaucagcaagugcucuagauagaagagcucccacaagaaaccaaccucaagcaccaggugucgaagcaucaggagcuggugaagcucgugcuucuacgggaucuucagauucaucacccggaggacacggaacacaaguaaauguaacaugcauaguaaaugucuguuccaguucggaucauucaucacaauguucaucacaagcaucaucuacuaugggagauacagauaguucaccaucagaauccccaaaagacgaacaaguaccauuuucaaaagaagaaugcgcauuuagaucacaauuagaaacaccagaaacauuauuaggaucaacugaagaaaaaccacuaccacuaggcguaccagaugcaggaaugaaacccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3791 - RNA, 895 nt, Artificial Sequence
  mRNA product Design2 comprising derived and/or modified sequence from Homo sapiens__NP_002623.2__HsPGF (opt13)
ggggcgcugccuacggagguggcagccaucuccuucucggcaucaagcuuaccaugccaguaaugagauuauuuccauguuucuuacaauuauuagcaggauuagcauuaccagcaguaccaccacaacaaugggcguuaucagcaggaaauggaaguagugaaguagaaguaguaccauuucaagaaguauggggaagaucauauuguagagcacuagaaagacuaguagauguaguaagugaauauccaagcgaaguagaacauauguuuucaccaucauguguaaguuuauuaagauguacgggaugcuguggagaugaaaauuuacauuguguaccaguagaaacagcaaauguaacaaugcaauuauuaaaaauaagaaguggagauagaccaucauauguagaauuaacauuuagccaacauguaagaugugaauguagaccauuaagagaaaaaaugaaaccagaaagaagaagaccaaaaggaagaggaaaaagaagaagagaaaaacaaagaccaacagauugucauuuauguggagaugcaguaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3792 - RNA, 1621 nt, Artificial Sequence
  mRNA product Design2 comprising derived and/or modified sequence from Homo sapiens__NP_001020537.2__HsVEGFA (opt13)
ggggcgcugccuacggagguggcagccaucuccuucucggcaucaagcuuaccaugacagauagacaaacagauacagcgccaaguccaucauaccauuuauuaccaggaagaagaagaacaguagaugcagcagcgaguagaggacaaggaccagagccagcaccaggaggaggaguagaaggaguuggagcaagaggaguagcgcuaaaauuauuuguacaacuauuaggaugcaguagauucgguggagcaguaguaagagcuggagaagcagaaccauccggugcagccagaagcgcaaguaguggaagagaagaaccacaaccagaagaaggagaagaagaagaagaaaaagaagaggaaagaggaccacaauggagacuuggcgcuagaaaaccugggagcuggacaggagaagcagcuguaugcgcagauagugcaccagcagcaagagcaccacaagcauuagcaagagcaucaggacgaggaggaagaguagcaagaaggggagccgaagaaaguggaccuccacauaguccaaguagaagaggaucagcaaguagagcugggccaggaagggcaucugaaacaaugaauuuuuuauuaaguuggguacauuggaguuuagcuuuauugcuauauuuacaucacgcaaaauggagucaagcagcaccaauggcagaaggagggggacaaaaucaucacgaaguaguaaaauuuauggauguuuaucaaaggaguuauugucauccuauagaaacguuaguagauauauuucaagaauacccagaugaaauagaguauauauuuaaaccgaguuguguaccauuaaugagauguggaggauguuguaaugacgaaggacuagaauguguaccaacagaagaaagcaauauaacuaugcagauaaugagaauaaaaccucaucaaggacaacauauaggagaaaugaguuuuuugcaacacaauaagugcgaauguagaccaaaaaaagaucgagcaagacaagaaaaaaaaagcguaagagguaaagguaaaggacaaaaaagaaaaagaaaaaaaaguagauauaaaagcuggaguguauacguaggggcaagauguuguuugaugccauggagccucccaggaccucauccguguggaccauguucagagagaagaaaacaucuguuuguacaagauccacaaacauguaaaugcaguugcaaaaauacggauucaagauguaaagcgagacaauuagaauuaaaugaaaggacauguagaugcgauaagccgagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3793 - RNA, 1081 nt, Artificial Sequence
  mRNA product Design2 comprising derived and/or modified sequence from Homo sapiens__NP_001165094.1__HsVEGFA (opt13)
ggggcgcugccuacggagguggcagccaucuccuucucggcaucaagcuuaccaugaacuucuuacuaucauggguacauuggagcuuagcacuauuacuauaccuacaccacgcaaaauggucacaagcagcaccaauggcagaaggaggaggacaaaaccaccaugaaguaguaaaauucauggauguauaccaaagaucauacugccacccaauagaaacacuaguagacauauuccaagaauacccagacgaaauagaauacauauucaaaccaucauguguaccauuaaugagaugcggaggaugcugcaacgacgaaggacuagaauguguaccaacagaagaaaguaacauaacaaugcaaauaaugagaauaaaaccacaucaaggacaacacauaggagaaaugagcuuccuacaacacaauaaaugcgaaugcagaccaaaaaaagacagagcaagacaagaaaaaaaaaguguaagaggaaaaggaaaaggacaaaaaagaaaaagaaaaaaaucaagauacaaaucauggucaguauacguaggagcaagaugcugccuaaugccauggucacuaccaggaccacacccaugcggaccaugcucagaaagaagaaaacaccuauucguacaagacccacaaaccugcaaaugcaguugcaaaaacacagacagcagaugcaaagcaagacaauuagaacuaaacgaaagaacaugcagaugcgauaaaccacgaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3794 - RNA, 1006 nt, Artificial Sequence
  mRNA product Design2 comprising derived and/or modified sequence from Homo sapiens__NP_003368.1__HsVEGFB (opt13)
ggggcgcugccuacggagguggcagccaucuccuucucggcaucaagcuuaccaugucaccacuauuaagaagauuauuacuagcagcauuacuacaauuagcacccgcacaagcaccuguaucacaaccagaugcaccaggacaucaaagaaaaguaguaucauggauagacguauacacaagagcaacaugucaaccaagagaaguaguaguaccauuaacaguagaacuaaugggaacagucgcaaaacaacuaguaccaucaugcguaacaguacaaagaugcggaggcuguuguccagacgauggauuagaauguguuccaacaggacaacaucaaguaagaaugcaaauacuaaugauaagauacccaucaucucaacuaggagaaauguccuuagaagaacauagucaaugcgaaugcagaccaaaaaaaaaagauucagcaguaaaaccagaccgagcagcaacaccacaucauagaccacaaccacgaucaguaccaggcugggacucagccccaggagcaccaucaccagcagauauaacccaucccacaccugcaccaggaccaucugcacaugcagcaccuucaacaacaucagcauuaacaccaggaccagcagcagcagccgcagacgcagcugcaucaucaguagcaaaaggaggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3795 - RNA, 1642 nt, Artificial Sequence
  mRNA product Design2 comprising derived and/or modified sequence from Homo sapiens__NP_005420.1__HsVEGFC (opt13)
ggggcgcugccuacggagguggcagccaucuccuucucggcaucaagcuuaccaugcaccucuuaggauucuucucaguagcuugcucauuauuagccgccgccuuauuaccaggaccaagagaagcaccagcagcagccgcagcauuugaaucaggauuagacuuaagugaugcugaaccagacgcaggagaagcuacagcauaugccaguaaagacuuagaagaacaauuaagaucaguaaguuccguagacgaauuaaugacaguacucuauccagaauacuggaaaauguauaaaugucaacuaagaaaaggcggauggcaacauaauagggaacaagcaaaucuaaauucaagaacagaagaaacuauaaaauucgcagccgcacacuauaacacggaaauacuaaaaaguauagauaacgaauggagaaaaacacaaugcaugccaagagaaguaugcauagauguaggaaaagaauuuggaguagcaacaaacacauuuuucaaaccaccauguguaagcguauacagauguggcgguugcugcaauagcgaaggauuacaauguaugaacacuagcacuucauacuuaucaaaaacacuauuugaaauuacaguaccauuaagucaaggaccuaaaccaguaacgauaaguuuugcaaaccacacaucauguagauguaugucaaaacuagauguauauagacaaguacacucaauaauaagaagaucacuaccagcaacacuuccacaaugccaagcagcaaauaaaacauguccaacaaacuauauguggaacaaccacauaugcagaugucuagcacaagaagauuucauguuuaguucagacgcaggagacgacagcacagauggauuucaugacauaugcggacccaacaaagaauuagacgaagaaacuugucaaugcguauguagagcaggacuacgaccagcaucauguggaccacauaaagaauuagacagaaacaguugccaaugcguaugcaaaaauaaacuauucccaucacaauguggagcaaaucgagaauuugaugaaaacacaugucaauguguaugcaaaagaacaugcccaagaaaucaaccauuaaauccagguaaaugcgcaugugaauguacagaaucaccacaaaaaugccuauuaaaaggaaagaaauuucaccaucaaacaugcaguuguuauagaagaccauguacaaauagacaaaaagccugugaaccaggauucuccuacucagaagaaguauguagauguguaccaaguuacuggaaaagaccacaaaugucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3796 - RNA, 1447 nt, Artificial Sequence
  mRNA product Design2 comprising derived and/or modified sequence from Homo sapiens__NP_004460.1__HsVEGFD (opt13)
ggggcgcugccuacggagguggcagccaucuccuucucggcaucaagcuuaccauguaccgagaauggguaguaguaaacguauucaugaugcuuuacguacaacuaguacaaggaucaucaaaugaacacggaccaguaaaaagaucaagccaaucaacauuagaaagaucagaacaacaaauacgagcagcaucaucacucgaagaacuccuaagaauaacacacuccgaagacuggaaacuauggcgaugcagacuaagauuaaaaucauucacaucaauggauucacgcuccgcaucccacagaucaacaagauuugccgccacauuuuacgacauagaaacauuaaaagucaucgacgaagaauggcaacgaacacaaugcucaccuagagaaacaugcguagaaguagcaucagaacuagguaaauccacaaauaccuuuuuuaaaccaccuugcguaaacguauucagaugcggaggcuguugcaacgaagaaucacuaauuuguaugaacacaucuacauccuacauaucaaaacaacuauucgaaauaucaguaccacuaacaagcguacccgaacuaguccccguaaaaguagcaaaccacacaggaugcaaaugccuaccaacagcaccaagacauccauacuccauaauacgaagaucaauacaaauaccagaagaagacagaugcucacacucaaaaaaacuaugcccuauagauaugcuaugggacagcaacaaaugcaaaugcguacuacaagaagaaaacccucuagcaggaaccgaagaccacagccaucuacaagaaccagcauuaugcgguccacauaugauguucgacgaagacagaugcgaaugcguaugcaaaacaccaugccccaaagaccuuauacaacacccuaaaaacuguagcugcuuugaaugcaaagaaucacuagaaacaugcugccaaaaacacaaauuauuucacccagacacaugcucaugcgaagacagaugcccauuccacaccagaccaugcgcauccgguaaaacagcaugugcaaaacacugcagauuccccaaagaaaaaagagcagcccaaggaccacacucaagaaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 3797 - RNA, 977 nt, Artificial Sequence
  mRNA product Design3 comprising derived and/or modified sequence from Homo sapiens__NP_061986.1__HsFGF21 (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccugccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3798 - RNA, 977 nt, Artificial Sequence
  mRNA product Design3 comprising derived and/or modified sequence from Homo sapiens__NP_061986.1__HsFGF21 (wt)
gggagagucccgcagucggcguccagcggcucugcuuguucgugugugugucguugcaggccuuauucaagcuuaccauggacucggacgagaccggguucgagcacucaggacuguggguuucugugcuggcuggucuucugcugggagccugccaggcacaccccaucccugacuccaguccucuccugcaauucgggggccaaguccggcagcgguaccucuacacagaugaugcccagcagacagaagcccaccuggagaucagggaggaugggacgguggggggcgcugcugaccagagccccgaaagucuccugcagcugaaagccuugaagccgggaguuauucaaaucuugggagucaagacauccagguuccugugccagcggccagauggggcccuguauggaucgcuccacuuugacccugaggccugcagcuuccgggagcugcuucuugaggacggauacaauguuuaccaguccgaagcccacggccucccgcugcaccucccagggaacaaguccccacaccgggacccugcaccccgaggaccagcucgcuuccugccacuaccaggccugccccccgcacucccggagccacccggaauccuggccccccagccccccgaugugggcuccucggacccucugagcauggugggaccuucccagggccgaagccccagcuacgcuuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3799 - RNA, 1757 nt, Artificial Sequence
  mRNA product Design3 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaauucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3800 - RNA, 1757 nt, Artificial Sequence
  mRNA product Design3 comprising derived and/or modified sequence from Homo sapiens__NP_002412.1__HsMMP1 (wt)
gggagagucccgcagucggcguccagcggcucugcuuguucgugugugugucguugcaggccuuauucaagcuuaccaugcacagcuuuccuccacugcugcugcugcuguucugggguguggugucucacagcuucccagcgacucuagaaacacaagagcaagauguggacuuaguccagaaauaccuggaaaaauacuacaaccugaagaaugaugggaggcaaguugaaaagcggagaaauaguggcccagugguugaaaaauugaagcaaaugcaggaguucuuugggcugaaagugacugggaaaccagaugcugaaacccugaaggugaugaagcagcccagauguggagugccugauguggcucaguuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3801 - RNA, 1517 nt, Artificial Sequence
  mRNA product Design3 comprising derived and/or modified sequence from Homo sapiens__NP_002412.1__HsMMP1(1-19,100-469) (wt)
gggagagucccgcagucggcguccagcggcucugcuuguucgugugugugucguugcaggccuuauucaagcuuaccaugcacagcuuuccuccacugcugcugcugcuguucugggguguggugucucacagcuuuguccucacugaggggaacccucgcugggagcaaacacaucugaccuacaggauugaaaauuacacgccagauuugccaagagcagauguggaccaugccauugagaaagccuuccaacucuggaguaaugucacaccucugacauucaccaaggucucugagggucaagcagacaucaugauaucuuuugucaggggagaucaucgggacaacucuccuuuugauggaccuggaggaaaucuugcucaugcuuuucaaccaggcccagguauuggaggggaugcucauuuugaugaagaugaaagguggaccaacaauuucagagaguacaacuuacaucguguugcagcucaugaacucggccauucucuuggacucucccauucuacugauaucggggcuuugauguacccuagcuacaccuucaguggugauguucagcuagcucaggaugacauugauggcauccaagccauauauggacguucccaaaauccuguccagcccaucggcccacaaaccccaaaagcgugugacaguaagcuaaccuuugaugcuauaacuacgauucggggagaagugauguucuuuaaagacagauucuacaugcgcacaaaucccuucuacccggaaguugagcucaauuucauuucuguuuucuggccacaacugccaaaugggcuugaagcugcuuacgaauuugccgacagagaugaaguccgguuuuucaaagggaauaaguacugggcuguucagggacagaaugugcuacacggauaccccaaggacaucuacagcuccuuuggcuucccuagaacugugaagcauaucgaugcugcucuuucugaggaaaacacuggaaaaaccuacuucuuuguugcuaacaaauacuggagguaugaugaauauaaacgaucuauggauccagguuaucccaaaaugauagcacaugacuuuccuggaauuggccacaaaguugaugcaguuuucaugaaagauggauuuuucuauuucuuucauggaacaagacaauacaaauuugauccuaaaacgaagagaauuuugacucuccagaaagcuaauagcugguucaacugcaggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3802 - RNA, 3704 nt, Artificial Sequence
  mRNA product Design3 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3803 - RNA, 3704 nt, Artificial Sequence
  mRNA product Design3 comprising derived and/or modified sequence from Clostridium histolyticum__BAA77453.1__ColG (wt)
gggagagucccgcagucggcguccagcggcucugcuuguucgugugugugucguugcaggccuuauucaagcuuaccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3804 - RNA, 3428 nt, Artificial Sequence
  mRNA product Design3 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3805 - RNA, 3428 nt, Artificial Sequence
  mRNA product Design3 comprising derived and/or modified sequence from Clostridium histolyticum__BAA77453.1__HsALB(1-18)_ColG(111-1118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3806 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3807 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3808 - RNA, 3452 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3809 - RNA, 3452 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaauuuuuuaaaaauuauuuuaaauagggggaagacuaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3810 - RNA, 3413 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3811 - RNA, 3413 nt, Artificial Sequence
  mRNA product Design3 comprising derived and/or modified sequence from Clostridium histolyticum__BAA34542.1__ColH (wt)
gggagagucccgcagucggcguccagcggcucugcuuguucgugugugugucguugcaggccuuauucaagcuuaccaugaaaaggaaauguuuaucuaaaaggcuuauguuagcuauaacaauggcuacaauauuuacagugaacaguacauuaccaauuuaugcagcuguagauaaaaauaaugcaacagcagcuguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3812 - RNA, 3347 nt, Artificial Sequence
  mRNA product Design3 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3813 - RNA, 3347 nt, Artificial Sequence
  mRNA product Design3 comprising derived and/or modified sequence from Clostridium histolyticum__BAA34542.1__HsALB(1-18)_ColH(41-1021) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3814 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3815 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (wt)
gggagagucccgcagucggcguccagcggcucugcuuguucgugugugugucguugcaggccuuauucaagcuuaccaugaaguggguaaccuuuauuucccuucuuuuucucuuuagcucggcuuauuccaugaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3816 - RNA, 923 nt, Artificial Sequence
  mRNA product Design3 comprising derived and/or modified sequence from Homo sapiens__NP_001133.1__HsAMELX (wt)
gggagagucccgcagucggcguccagcggcucugcuuguucgugugugugucguugcaggccuuauucaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcuuggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3817 - RNA, 923 nt, Artificial Sequence
  mRNA product Design3 comprising derived and/or modified sequence from Homo sapiens__NP_001133.1__HsAMELX (wt)
gggagagucccgcagucggcguccagcggcucugcuuguucgugugugugucguugcaggccuuauucaagcuuaccauggggaccuggauuuuauuugccugccuccugggagcagcuuuugccaugccucuaccaccucauccugggcacccugguuauaucaacuucagcuaugaggugcuuaccccuuugaagugguaccagagcauaaggccaccguacccuuccuaugguuacgagcccauggguggauggcugcaccaccaaaucauccccgugcugucccaacagcaccccccgacucacacccugcagccucaucaccacaucccaguggugccagcucagcagcccgugaucccccagcaaccaaugaugcccguuccuggccaacacuccaugacuccaauccaacaccaccagccaaaccucccuccgcccgcccagcagcccuaccagccccagccuguucagccacagccucaccagcccaugcagccccagccaccugugcaccccaugcagccccugccgccacagccaccucugccuccgauguuccccaugcagccccugccucccaugcuuccugaucugacucuggaagcauggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3818 - RNA, 482 nt, Artificial Sequence
  mRNA product Design3 comprising derived and/or modified sequence from Homo sapiens__NP_001133.1__HsAMELX-TRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccuuugaagugguaccagagcauaaggccaccguacccuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3819 - RNA, 515 nt, Artificial Sequence
  mRNA product Design3 comprising derived and/or modified sequence from Homo sapiens__NP_001133.1__HsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccuuugaagugguaccagagcauaaggccaccucccaugcuuccugaucugacucuggaagcuuggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3820 - RNA, 515 nt, Artificial Sequence
  mRNA product Design3 comprising derived and/or modified sequence from Homo sapiens__NP_001133.1__HsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3821 - RNA, 554 nt, Artificial Sequence
  mRNA product Design3 comprising derived and/or modified sequence from Homo sapiens__NP_001133.1__HLA-A2-SP_HsAMELX(17-60) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccguacccuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3822 - RNA, 587 nt, Artificial Sequence
  mRNA product Design3 comprising derived and/or modified sequence from Homo sapiens__NP_001133.1__HLA-A2-SP_HsAMELX(17-47,168-191) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccuuugaagugguaccagagcauaaggccaccucccaugcuuccugaucugacucuggaagcauggccaucaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3823 - RNA, 926 nt, Artificial Sequence
  mRNA product Design3 comprising derived and/or modified sequence from Homo sapiens__NP_001134.1__HsAMELY (wt)
gggagagucccgcagucggcguccagcggcucugcuuguucgugugugugucguugcaggccuuauucaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcuuggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3824 - RNA, 926 nt, Artificial Sequence
  mRNA product Design3 comprising derived and/or modified sequence from Homo sapiens__NP_001134.1__HsAMELY (wt)
gggagagucccgcagucggcguccagcggcucugcuuguucgugugugugucguugcaggccuuauucaagcuuaccauggggaccuggauuuuguuugccugccuugugggagcagcuuuugccaugccucuaccaccucauccugggcacccugguuauaucaacuucagcuaugaggugcucaccccuuugaagugguaccagagcaugauaagaccaccauacucuuccuaugguuacgagcccauggguggauggcugcaccaccaaaucauccccguggugucccaacagcacccccugacucacacccugcagucucaucaccacaucccaguggugccagcucagcagcccaggguccgccagcaagcacugaugccuguuccuggccagcaauccaugacuccaacccaacaccaucagccaaaccucccucugccugcccagcagcccuuccagccccagccuguucagccacagccucaccagcccaugcagccccagccaccugugcaacccaugcagccccugcugccacagccaccucugccuccaauguucccccugcggccccugccccccauacuuccugaucugcaucuggaagcauggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3825 - RNA, 485 nt, Artificial Sequence
  mRNA product Design3 comprising derived and/or modified sequence from Homo sapiens__NP_001134.1__HsAMELY-TRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcucaccccuuugaagugguaccagagcaugauaagaccaccauacucuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3826 - RNA, 518 nt, Artificial Sequence
  mRNA product Design3 comprising derived and/or modified sequence from Homo sapiens__NP_001134.1__HsAMELY-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcucaccccuuugaagugguaccagagcaugauaagaccaccccccauacuuccugaucugcaucuggaagcuuggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3827 - RNA, 518 nt, Artificial Sequence
  mRNA product Design3 comprising derived and/or modified sequence from Homo sapiens__NP_001134.1__HsAMELY-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3828 - RNA, 557 nt, Artificial Sequence
  mRNA product Design3 comprising derived and/or modified sequence from Homo sapiens__NP_001134.1__HLA-A2-SP_HsAMELY(17-61) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccauacucuuccuaugguuacgagcccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3829 - RNA, 590 nt, Artificial Sequence
  mRNA product Design3 comprising derived and/or modified sequence from Homo sapiens__NP_001134.1__HLA-A2-SP_HsAMELY(17-48,169-192) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcucaccccuuugaagugguaccagagcaugauaagaccaccccccauacuuccugaucugcaucuggaagcauggccagcaacagacaagaccaagcaggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3830 - RNA, 917 nt, Artificial Sequence
  mRNA product Design3 comprising derived and/or modified sequence from Sus scrofa__NP_999071.1__SsAMELX-001-1 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3831 - RNA, 917 nt, Artificial Sequence
  mRNA product Design3 comprising derived and/or modified sequence from Sus scrofa__NP_999071.1__SsAMELX-001-1 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3832 - RNA, 485 nt, Artificial Sequence
  mRNA product Design3 comprising derived and/or modified sequence from Sus scrofa__NP_999071.1__SsAMELX-TRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccguacacuuccuauggguacgaacccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3833 - RNA, 518 nt, Artificial Sequence
  mRNA product Design3 comprising derived and/or modified sequence from Sus scrofa__NP_999071.1__SsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3834 - RNA, 518 nt, Artificial Sequence
  mRNA product Design3 comprising derived and/or modified sequence from Sus scrofa__NP_999071.1__SsAMELX-LRAP (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3835 - RNA, 557 nt, Artificial Sequence
  mRNA product Design3 comprising derived and/or modified sequence from Sus scrofa__NP_999071.1__HLA-A2-SP_SsAMEL(17-61) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccguacacuuccuauggguacgaacccauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3836 - RNA, 590 nt, Artificial Sequence
  mRNA product Design3 comprising derived and/or modified sequence from Sus scrofa__NP_999071.1__HLA-A2-SP_SsAMEL(17-49,167-189) (wt)
gggagagucccgcagucggcguccagcggcucugcuuguucgugugugugucguugcaggccuuauucaagcuuaccauggccgucauggcgccccgaacccucguccugcuacucucgggggcucuggcccugacccagaccugggcgaugccucuaccaccucauccugggcacccugguuauaucaacuucagcuaugaggugcuuaccccucugaagugguaccagaacaugauaagacauccgucucugcuuccugaccugccucuggaagcauggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3837 - RNA, 881 nt, Artificial Sequence
  mRNA product Design3 comprising derived and/or modified sequence from Sus scrofa__P45561-2__SsAMELX-001-2 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuauauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3838 - RNA, 917 nt, Artificial Sequence
  mRNA product Design3 comprising derived and/or modified sequence from Sus scrofa__NP_998965.1__SsAMELX-001-3 (wt)
gggagagucccgcagucggcguccagcggcucugcuuguucgugugugugucguugcaggccuuauucaagcuuaccauggggaccuggauuuucuuugccugccuuuugggagcaucccuugcuaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3839 - RNA, 566 nt, Artificial Sequence
  mRNA product Design3 comprising derived and/or modified sequence from Sus scrofa__K7GPB2__SsAMELX-002 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3840 - RNA, 959 nt, Artificial Sequence
  mRNA product Design3 comprising derived and/or modified sequence from Sus scrofa__K7GLD0__SsAMELX-003 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggacuuauacuuggaggcuauccguauugacaggacugcauucgugcuuaccccucugaagugguaccagaacaugauaagacauccguacacuuccuaugguuacgaacccauggguggauggcugcaccaccaaaucauucccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3841 - RNA, 845 nt, Artificial Sequence
  mRNA product Design3 comprising derived and/or modified sequence from Sus scrofa__K7GPE9__SsAMELX-004 (wt)
gggagagucccgcagucggcguccagcggcucugcuuguucgugugugugucguugcaggccuuauucaagcuuaccauggggaccuggauuuuguuugcuugccuccugggagcagccuucucuaugccucuaccaccucauccugggcacccugguuauaucaacuucagcuaugaggugcuuaccccucugaagugguaccagaacaugauaagacauccgacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3842 - RNA, 869 nt, Artificial Sequence
  mRNA product Design3 comprising derived and/or modified sequence from Sus scrofa__J9JIM4__SsAMELX-201 (wt)
gggagagucccgcagucggcguccagcggcucugcuuguucgugugugugucguugcaggccuuauucaagcuuaccaugccucuaccaccucauccugggcacccugguuauaucaacuucagcuaugaggugcuuaccccucugaagugguaccagaacaugauaagacauccguacacuuccuauggguacgaacccauggguggauggcugcaccaccaaaucauacccguggugucgcagcagacuccccagagucaugcccuucagccucaucaccacauccccauggugccagcucaacagcccgggaucccccagcagccaaugaugccacuuccuggccaacacuccaugacuccaacccaacaccaccagccaaaccucccucugcccgcccagcagcccuuccagccccagcccguccagccccagccucaccagccccugcagccccagucacccaugcaccccauccagcccuugcugccacagccaccucugccuccgauguucuccaugcagucucugcuuccugaccugccucuggaagcuuggccagcaacagacaagaccaagcgggaggaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3843 - RNA, 3308 nt, Artificial Sequence
  mRNA product Design3 comprising derived and/or modified sequence from Homo sapiens__NP_006120.1__HsBMP1 (wt)
gggagagucccgcagucggcguccagcggcucugcuuguucgugugugugucguugcaggccuuauucaagcuuaccaugcccggcguggcccgccugccgcugcugcucgggcugcugcugcucccgcgucccggccggccgcuggacuuggccgacuacaccuaugaccuggcggaggaggacgacucggagccccucaacuacaaagaccccugcaaggcggcugccuuucuuggggacauugcccuggacgaagaggaccugagggccuuccagguacagcaggcuguggaucucagacggcacacagcucguaaguccuccaucaaagcugcaguuccaggaaacacuucuacccccagcugccagagcaccaacgggcagccucagaggggagccugugggagauggagagguagaucccguagccggcgggcggcgacgucccgaccagagcguguguggcccgauggggucauccccuuugucauugggggaaacuucacugguagccagagggcagucuuccggcaggccaugaggcacugggagaagcacaccugugucaccuuccuggagcgcacugacgaggacagcuauauuguguucaccuaucgaccuugcgggugcugcuccuacgugggucgccgcggcgggggcccccaggccaucuccaucggcaagaacugugacaaguucggcauugugguccacgagcugggccacgucgucggcuucuggcacgaacacacucggccagaccgggaccgccacguuuccaucguucgugagaacauccagccagggcaggaguauaacuuccugaagauggagccucaggagguggagucccugggggagaccuaugacuucgacagcaucaugcauuacgcucggaacacauucuccaggggcaucuuccuggauaccauuguccccaaguaugaggugaacggggugaaaccucccauuggccaaaggacacggcucagcaagggggacauugcccaagcccgcaagcuuuacaagugcccagccuguggagagacccugcaagacagcacaggcaacuucuccuccccugaauaccccaauggcuacucugcucacaugcacugcguguggcgcaucucugucacacccggggagaagaucauccugaacuucacgucccuggaccuguaccgcagccgccugugcugguacgacuauguggagguccgagauggcuucuggaggaaggcgccccuccgaggccgcuucugcggguccaaacucccugagccuaucgucuccacugacagccgccucuggguugaauuccgcagcagcagcaauuggguuggaaagggcuucuuugcagucuacgaagccaucugcgggggugaugugaaaaaggacuauggccacauucaaucgcccaacuacccagacgauuaccggcccagcaaagucugcaucuggcggauccaggugucugagggcuuccacgugggccucacauuccaguccuuugagauugagcgccacgacagcugugccuacgacuaucuggaggugcgcgacgggcacagugagagcagcacccucaucgggcgcuacuguggcuaugagaagccugaugacaucaagagcacguccagccgccucuggcucaaguucgucucugacggguccauuaacaaagcgggcuuugccgucaacuuuuucaaagagguggacgagugcucucggcccaaccgcgggggcugugagcagcggugccucaacacccugggcagcuacaagugcagcugugaccccggguacgagcuggccccagacaagcgccgcugugaggcugcuuguggcggauuccucaccaagcucaacggcuccaucaccagcccgggcuggcccaaggaguacccccccaacaagaacugcaucuggcagcugguggcccccacccaguaccgcaucucccugcaguuugacuucuuugagacagagggcaaugaugugugcaaguacgacuucguggaggugcgcaguggacucacagcugacuccaagcugcauggcaaguucugugguucugagaagcccgaggucaucaccucccaguacaacaacaugcgcguggaguucaaguccgacaacaccguguccaaaaagggcuucaaggcccacuucuucucagacaaggacgagugcuccaaggauaacggcggcugccagcaggacugcgucaacacguucggcaguuaugagugccaaugccgcaguggcuucguccuccaugacaacaagcacgacugcaaagaagccggcugugaccacaaggugacauccaccagugguaccaucaccagccccaacuggccugacaaguaucccagcaagaaggagugcacgugggccaucuccagcacccccgggcaccgggucaagcugaccuucauggagauggacaucgagucccagccugagugugccuacgaccaccuagagguguucgacgggcgagacgccaaggcccccguccucggccgcuucugugggagcaagaagcccgagcccguccuggccacaggcagccgcauguuccugcgcuucuacucagauaacucgguccagcgaaagggcuuccaggccucccacgccacagagugcgggggccagguacgggcagacgugaagaccaaggaccuuuacucccacgcccaguuuggcgacaacaacuacccuggggguguggacugugagugggucauuguggccgaggaaggcuacggcguggagcucguguuccagaccuuugagguggaggaggagaccgacugcggcuaugacuacauggagcucuucgacggcuacgacagcacagcccccaggcuggggcgcuacuguggcucagggccuccugaggagguguacucggcgggagauucuguccuggugaaguuccacucggaugacaccaucaccaaaaaagguuuccaccugcgauacaccagcaccaaguuccaggacacacuccacagcaggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3844 - RNA, 1538 nt, Artificial Sequence
  mRNA product Design3 comprising derived and/or modified sequence from Homo sapiens__NP_001191.1__HsBMP2 (wt)
gggagagucccgcagucggcguccagcggcucugcuuguucgugugugugucguugcaggccuuauucaagcuuaccaugguggccgggacccgcugucuucuagcguugcugcuuccccagguccuccugggcggcgcggcuggccucguuccggagcugggccgcaggaaguucgcggcggcgucgucgggccgccccucaucccagcccucugacgagguccugagcgaguucgaguugcggcugcucagcauguucggccugaaacagagacccacccccagcagggacgccguggugccccccuacaugcuagaccuguaucgcaggcacucaggucagccgggcucacccgccccagaccaccgguuggagagggcagccagccgagccaacacugugcgcagcuuccaccaugaagaaucuuuggaagaacuaccagaaacgagugggaaaacaacccggagauucuucuuuaauuuaaguucuauccccacggaggaguuuaucaccucagcagagcuucagguuuuccgagaacagaugcaagaugcuuuaggaaacaauagcaguuuccaucaccgaauuaauauuuaugaaaucauaaaaccugcaacagccaacucgaaauuccccgugaccagacuuuuggacaccagguuggugaaucagaaugcaagcaggugggaaaguuuugaugucacccccgcugugaugcgguggacugcacagggacacgccaaccauggauucgugguggaaguggcccacuuggaggagaaacaaggugucuccaagagacauguuaggauaagcaggucuuugcaccaagaugaacacagcuggucacagauaaggccauugcuaguaacuuuuggccaugauggaaaagggcauccucuccacaaaagagaaaaacgucaagccaaacacaaacagcggaaacgccuuaaguccagcuguaagagacacccuuuguacguggacuucagugacgugggguggaaugacuggauuguggcucccccgggguaucacgccuuuuacugccacggagaaugcccuuuuccucuggcugaucaucugaacuccacuaaucaugccauuguucagacguuggucaacucuguuaacucuaagauuccuaaggcaugcugugucccgacagaacucagugcuaucucgaugcuguaccuugacgagaaugaaaagguuguauuaaagaacuaucaggacaugguuguggaggguugugggugucgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3845 - RNA, 1574 nt, Artificial Sequence
  mRNA product Design3 comprising derived and/or modified sequence from Homo sapiens__NP_001193.2__HsBMP4 (wt)
gggagagucccgcagucggcguccagcggcucugcuuguucgugugugugucguugcaggccuuauucaagcuuaccaugauuccugguaaccgaaugcugauggucguuuuauuaugccaaguccugcuaggaggcgcgagccaugcuaguuugauaccugagacggggaagaaaaaagucgccgagauucagggccacgcgggaggacgccgcucagggcagagccaugagcuccugcgggacuucgaggcgacacuucugcagauguuugggcugcgccgccgcccgcagccuagcaagagugccgucauuccggacuacaugcgggaucuuuaccggcuucagucuggggaggaggaggaagagcagauccacagcacuggucuugaguauccugagcgcccggccagccgggccaacaccgugaggagcuuccaccacgaagaacaucuggagaacaucccagggaccagugaaaacucugcuuuucguuuccucuuuaaccucagcagcaucccugagaacgaggugaucuccucugcagagcuucggcucuuccgggagcagguggaccagggcccugauugggaaaggggcuuccaccguauaaacauuuaugagguuaugaagcccccagcagaaguggugccugggcaccucaucacacgacuacuggacacgagacugguccaccacaaugugacacggugggaaacuuuugaugugagcccugcgguccuucgcuggacccgggagaagcagccaaacuaugggcuagccauugaggugacucaccuccaucagacucggacccaccagggccagcaugucaggauuagccgaucguuaccucaagggagugggaauugggcccagcuccggccccuccuggucaccuuuggccaugauggccggggccaugccuugacccgacgccggagggccaagcguagcccuaagcaucacucacagcgggccaggaagaagaauaagaacugccggcgccacucgcucuauguggacuucagcgaugugggcuggaaugacuggauuguggccccaccaggcuaccaggccuucuacugccauggggacugccccuuuccacuggcugaccaccucaacucaaccaaccaugccauugugcagacccuggucaauucugucaauuccaguauccccaaagccuguugugugcccacugaacugagugccaucuccaugcuguaccuggaugaguaugauaaggugguacugaaaaauuaucaggagaugguaguagagggaugugggugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3846 - RNA, 1889 nt, Artificial Sequence
  mRNA product Design3 comprising derived and/or modified sequence from Homo sapiens__NP_001709.1__HsBMP6 (wt)
gggagagucccgcagucggcguccagcggcucugcuuguucgugugugugucguugcaggccuuauucaagcuuaccaugccggggcuggggcggagggcgcaguggcugugcugguggugggggcugcugugcagcugcugcgggcccccgccgcugcggccgcccuugcccgcugccgcggccgccgccgccggggggcagcugcugggggacggcgggagccccggccgcacggagcagccgccgccgucgccgcaguccuccucgggcuuccuguaccggcggcucaagacgcaggagaagcgggagaugcagaaggagaucuugucggugcuggggcucccgcaccggccccggccccugcacggccuccaacagccgcagcccccggcgcuccggcagcaggaggagcagcagcagcagcagcagcugccucgcggagagcccccucccgggcgacugaaguccgcgccccucuucaugcuggaucuguacaacgcccuguccgccgacaacgacgaggacggggcgucggagggggagaggcagcaguccuggccccacgaagcagccagcucgucccagcgucggcagccgcccccgggcgccgcgcacccgcucaaccgcaagagccuucuggcccccggaucuggcagcggcggcgcguccccacugaccagcgcgcaggacagcgccuuccucaacgacgcggacauggucaugagcuuugugaaccugguggaguacgacaaggaguucuccccucgucagcgacaccacaaagaguucaaguucaacuuaucccagauuccugagggugagguggugacggcugcagaauuccgcaucuacaaggacuguguuauggggaguuuuaaaaaccaaacuuuucuuaucagcauuuaucaagucuuacaggagcaucagcacagagacucugaccuguuuuuguuggacacccguguaguaugggccucagaagaaggcuggcuggaauuugacaucacggccacuagcaaucuguggguugugacuccacagcauaacauggggcuucagcugagcguggugacaagggauggaguccacguccacccccgagccgcaggccuggugggcagagacggcccuuacgacaagcagcccuucaugguggcuuucuucaaagugagugaggugcacgugcgcaccaccaggucagccuccagccggcgccgacaacagagucguaaucgcucuacccagucccaggacguggcgcgggucuccagugcuucagauuacaacagcagugaauugaaaacagccugcaggaagcaugagcuguaugugaguuuccaagaccugggauggcaggacuggaucauugcacccaagggcuaugcugccaauuacugugauggagaaugcuccuucccacucaacgcacacaugaaugcaaccaaccacgcgauugugcagaccuugguucaccuuaugaaccccgaguauguccccaaaccgugcugugcgccaacuaagcuaaaugccaucucgguucuuuacuuugaugacaacuccaaugucauucugaaaaaauacaggaauaugguuguaagagcuuguggaugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3847 - RNA, 1643 nt, Artificial Sequence
  mRNA product Design3 comprising derived and/or modified sequence from Homo sapiens__NP_001710.1__HsBMP7 (wt)
gggagagucccgcagucggcguccagcggcucugcuuguucgugugugugucguugcaggccuuauucaagcuuaccaugcacgugcgcucacugcgagcugcggcgccgcacagcuucguggcgcucugggcaccccuguuccugcugcgcuccgcccuggccgacuucagccuggacaacgaggugcacucgagcuucauccaccggcgccuccgcagccaggagcggcgggagaugcagcgcgagauccucuccauuuugggcuugccccaccgcccgcgcccgcaccuccagggcaagcacaacucggcacccauguucaugcuggaccuguacaacgccauggcgguggaggagggcggcgggcccggcggccagggcuucuccuaccccuacaaggccgucuucaguacccagggccccccucuggccagccugcaagauagccauuuccucaccgacgccgacauggucaugagcuucgucaaccucguggaacaugacaaggaauucuuccacccacgcuaccaccaucgagaguuccgguuugaucuuuccaagaucccagaaggggaagcugucacggcagccgaauuccggaucuacaaggacuacauccgggaacgcuucgacaaugagacguuccggaucagcguuuaucaggugcuccaggagcacuugggcagggaaucggaucucuuccugcucgacagccguacccucugggccucggaggagggcuggcugguguuugacaucacagccaccagcaaccacuggguggucaauccgcggcacaaccugggccugcagcucucgguggagacgcuggaugggcagagcaucaaccccaaguuggcgggccugauugggcggcacgggccccagaacaagcagcccuucaugguggcuuucuucaaggccacggagguccacuuccgcagcauccgguccacggggagcaaacagcgcagccagaaccgcuccaagacgcccaagaaccaggaagcccugcggauggccaacguggcagagaacagcagcagcgaccagaggcaggccuguaagaagcacgagcuguaugucagcuuccgagaccugggcuggcaggacuggaucaucgcgccugaaggcuacgccgccuacuacugugagggggagugugccuucccucugaacuccuacaugaacgccaccaaccacgccaucgugcagacgcugguccacuucaucaacccggaaacggugcccaagcccugcugugcgcccacgcagcucaaugccaucuccguccucuacuucgaugacagcuccaacgucauccugaagaaauacagaaacauggugguccgggccuguggcugccacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3848 - RNA, 647 nt, Artificial Sequence
  mRNA product Design3 comprising derived and/or modified sequence from Homo sapiens__NP_006264.2__HsCCL7 (wt)
gggagagucccgcagucggcguccagcggcucugcuuguucgugugugugucguugcaggccuuauucaagcuuaccaugaaagccucugcagcacuucugugucugcugcucacagcagcugcuuucagcccccaggggcuugcucagccaguugggauuaauacuucaacuaccugcugcuacagauuuaucaauaagaaaaucccuaagcagaggcuggagagcuacagaaggaccaccaguagccacuguccccgggaagcuguaaucuucaagaccaaacuggacaaggagaucugugcugaccccacacagaaguggguccaggacuuuaugaagcaccuggacaagaaaacccaaacuccaaagcuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3849 - RNA, 3971 nt, Artificial Sequence
  mRNA product Design3 comprising derived and/or modified sequence from Homo sapiens__NP_001954.2__HsEGF (wt)
gggagagucccgcagucggcguccagcggcucugcuuguucgugugugugucguugcaggccuuauucaagcuuaccaugcugcucacucuuaucauucuguugccaguaguuucaaaauuuaguuuuguuagucucucagcaccgcagcacuggagcuguccugaagguacucucgcaggaaaugggaauucuacuuguguggguccugcacccuucuuaauuuucucccauggaaauaguaucuuuaggauugacacagaaggaaccaauuaugagcaauuggugguggaugcuggugucucagugaucauggauuuucauuauaaugagaaaagaaucuauuggguggauuuagaaagacaacuuuugcaaagaguuuuucugaaugggucaaggcaagagagaguauguaauauagagaaaaauguuucuggaauggcaauaaauuggauaaaugaagaaguuauuuggucaaaucaacaggaaggaaucauuacaguaacagauaugaaaggaaauaauucccacauucuuuuaagugcuuuaaaauauccugcaaauguagcaguugauccaguagaaagguuuauauuuuggucuucagagguggcuggaagccuuuauagagcagaucucgauggugugggagugaaggcucuguuggagacaucagagaaaauaacagcugugucauuggaugugcuugauaagcggcuguuuuggauucaguacaacagagaaggaagcaauucucuuauuugcuccugugauuaugauggagguucuguccacauuaguaaacauccaacacagcauaauuuguuugcaaugucccuuuuuggugaccguaucuucuauucaacauggaaaaugaagacaauuuggauagccaacaaacacacuggaaaggacaugguuagaauuaaccuccauucaucauuuguaccacuuggugaacugaaaguagugcauccacuugcacaacccaaggcagaagaugacacuugggagccugagcagaaacuuugcaaauugaggaaaggaaacugcagcagcacugugugugggcaagaccuccagucacacuugugcaugugugcagagggauacgcccuaagucgagaccggaaguacugugaagauguuaaugaaugugcuuuuuggaaucauggcuguacucuuggguguaaaaacaccccuggauccuauuacugcacgugcccuguaggauuuguucugcuuccugaugggaaacgaugucaucaacuuguuuccuguccacgcaaugugucugaaugcagccaugacuguguucugacaucagaaggucccuuauguuucuguccugaaggcucagugcuugagagagaugggaaaacauguagcgguuguuccucacccgauaaugguggauguagccagcucugcguuccucuuagcccaguauccugggaaugugauugcuuuccuggguaugaccuacaacuggaugaaaaaagcugugcagcuucaggaccacaaccauuuuugcuguuugccaauucucaagauauucgacacaugcauuuugauggaacagacuauggaacucugcucagccagcagaugggaaugguuuaugcccuagaucaugacccuguggaaaauaagauauacuuugcccauacagcccugaaguggauagagagagcuaauauggaugguucccagcgagaaaggcuuauugaggaaggaguagaugugccagaaggucuugcuguggacuggauuggccguagauucuauuggacagacagagggaaaucucugauuggaaggagugauuuaaaugggaaacguuccaaaauaaucacuaaggagaacaucucucaaccacgaggaauugcuguucauccaauggccaagagauuauucuggacugauacagggauuaauccacgaauugaaaguucuucccuccaaggccuuggccgucugguuauagccagcucugaucuaaucuggcccaguggaauaacgauugacuucuuaacugacaaguuguacuggugcgaugccaagcagucugugauugaaauggccaaucuggaugguucaaaacgccgaagacuuacccagaaugauguaggucacccauuugcuguagcaguguuugaggauuaugugugguucucagauugggcuaugccaucaguaaugagaguaaacaagaggacuggcaaagauagaguacgucuccaaggcagcaugcugaagcccucaucacugguugugguucauccauuggcaaaaccaggagcagaucccugcuuauaucaaaacggaggcugugaacauauuugcaaaaagaggcuuggaacugcuugguguucgugucgugaagguuuuaugaaagccucagaugggaaaacgugucuggcucuggauggucaucagcuguuggcagguggugaaguugaucuaaagaaccaaguaacaccauuggacaucuuguccaagacuagagugucagaagauaacauuacagaaucucaacacaugcuaguggcugaaaucauggugucagaucaagaugacugugcuccugugggaugcagcauguaugcucgguguauuucagagggagaggaugccacaugucaguguuugaaaggauuugcuggggauggaaaacuauguucugauauagaugaaugugagaugggugucccagugugccccccugccuccuccaagugcaucaacaccgaaggugguuaugucugccggugcucagaaggcuaccaaggagaugggauucacugucuugauauugaugagugccaacugggggagcacagcuguggagagaaugccagcugcacaaauacagagggaggcuauaccugcaugugugcuggacgccugucugaaccaggacugauuugcccugacucuacuccacccccucaccucagggaagaugaccaccacuauuccguaagaaauagugacucugaauguccccugucccacgauggguacugccuccaugauggugugugcauguauauugaagcauuggacaaguaugcaugcaacuguguuguuggcuacaucggggagcgaugucaguaccgagaccugaaguggugggaacugcgccacgcuggccacgggcagcagcagaaggucaucgugguggcugucugcgugguggugcuugucaugcugcuccuccugagccuguggggggcccacuacuacaggacucagaagcugcuaucgaaaaacccaaagaauccuuaugaggagucgagcagagaugugaggagucgcaggccugcugacacugaggaugggauguccucuugcccucaaccuugguuugugguuauaaaagaacaccaagaccucaagaaugggggucaaccaguggcuggugaggauggccaggcagcagaugggucaaugcaaccaacuucauggaggcaggagccccaguuauguggaaugggcacagagcaaggcugcuggauuccaguauccagugauaagggcuccuguccccagguaauggagcgaagcuuucauaugcccuccuaugggacacagacccuugaagggggugucgagaagccccauucucuccuaucagcuaacccauuauggcaacaaagggcccuggacccaccacaccaaauggagcugacucagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3850 - RNA, 857 nt, Artificial Sequence
  mRNA product Design3 comprising derived and/or modified sequence from Homo sapiens__NP_001423.1__HsEREG (wt)
gggagagucccgcagucggcguccagcggcucugcuuguucgugugugugucguugcaggccuuauucaagcuuaccaugaccgcggggaggaggauggagaugcucugugccggcagggucccugcgcugcugcucugccuggguuuccaucuucuacaggcaguccucaguacaacugugauuccaucauguaucccaggagaguccagugauaacugcacagcuuuaguucagacagaagacaauccacguguggcucaagugucaauaacaaaguguagcucugacaugaauggcuauuguuugcauggacagugcaucuaucugguggacaugagucaaaacuacugcaggugugaaguggguuauacugguguccgaugugaacacuucuuuuuaaccguccaccaaccuuuaagcaaagaauauguggcuuugaccgugauucuuauuauuuuguuucuuaucacagucgucgguuccacauauuauuucugcagaugguacagaaaucgaaaaaguaaagaaccaaagaaggaauaugagagaguuaccucaggggauccagaguugccgcaagucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3851 - RNA, 815 nt, Artificial Sequence
  mRNA product Design3 comprising derived and/or modified sequence from Homo sapiens__NP_000791.1__HsFGF1 (wt)
gggagagucccgcagucggcguccagcggcucugcuuguucgugugugugucguugcaggccuuauucaagcuuaccauggcugaaggggaaaucaccaccuucacagcccugaccgagaaguuuaaucugccuccagggaauuacaagaagcccaaacuccucuacuguagcaacgggggccacuuccugaggauccuuccggauggcacaguggaugggacaagggacaggagcgaccagcacauucagcugcagcucagugcggaaagcgugggggagguguauauaaagaguaccgagacuggccaguacuuggccauggacaccgacgggcuuuuauacggcucacagacaccaaaugaggaauguuuguuccuggaaaggcuggaggagaaccauuacaacaccuauauauccaagaagcaugcagagaagaauugguuuguuggccucaagaagaaugggagcugcaaacgcgguccucggacucacuauggccagaaagcaaucuuguuucucccccugccagucucuucugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3852 - RNA, 1214 nt, Artificial Sequence
  mRNA product Design3 comprising derived and/or modified sequence from Homo sapiens__NP_001997.5__HsFGF2 (wt)
gggagagucccgcagucggcguccagcggcucugcuuguucgugugugugucguugcaggccuuauucaagcuuaccauggugggugugggggguggagauguagaagaugugacgccgcggcccggcgggugccagauuagcggacgcggugcccgcgguugcaacgggaucccgggcgcugcagcuugggaggcggcucuccccaggcggcguccgcggagacacccauccgugaaccccaggucccgggccgccggcucgccgcgcaccaggggccggcggacagaagagcggccgagcggcucgaggcugggggaccgcgggcgcggccgcgcgcugccgggcgggaggcuggggggccggggccggggccgugccccggagcgggucggaggccggggccggggccgggggacggcggcuccccgcgcggcuccagcggcucggggaucccggccgggccccgcagggaccauggcagccgggagcaucaccacgcugcccgccuugcccgaggauggcggcagcggcgccuucccgcccggccacuucaaggaccccaagcggcuguacugcaaaaacgggggcuucuuccugcgcauccaccccgacggccgaguugacgggguccgggagaagagcgacccucacaucaagcuacaacuucaagcagaagagagaggaguugugucuaucaaaggagugugugcuaaccguuaccuggcuaugaaggaagauggaagauuacuggcuucuaaauguguuacggaugaguguuucuuuuuugaacgauuggaaucuaauaacuacaauacuuaccggucaaggaaauacaccaguugguauguggcacugaaacgaacugggcaguauaaacuuggauccaaaacaggaccugggcagaaagcuauacuuuuucuuccaaugucugcuaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3853 - RNA, 932 nt, Artificial Sequence
  mRNA product Design3 comprising derived and/or modified sequence from Homo sapiens__NP_002000.1__HsFGF7 (wt)
gggagagucccgcagucggcguccagcggcucugcuuguucgugugugugucguugcaggccuuauucaagcuuaccaugcacaaauggauacugacauggauccugccaacuuugcucuacagaucaugcuuucacauuaucugucuaguggguacuauaucuuuagcuugcaaugacaugacuccagagcaaauggcuacaaaugugaacuguuccagcccugagcgacacacaagaaguuaugauuacauggaaggaggggauauaagagugagaagacucuucugucgaacacagugguaccugaggaucgauaaaagaggcaaaguaaaagggacccaagagaugaagaauaauuacaauaucauggaaaucaggacaguggcaguuggaauuguggcaaucaaagggguggaaagugaauucuaucuugcaaugaacaaggaaggaaaacucuaugcaaagaaagaaugcaaugaagauuguaacuucaaagaacuaauucuggaaaaccauuacaacacauaugcaucagcuaaauggacacacaacggaggggaaauguuuguugccuuaaaucaaaaggggauuccuguaagaggaaaaaaaacgaagaaagaacaaaaaacagcccacuuucuuccuauggcaauaacuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3854 - RNA, 974 nt, Artificial Sequence
  mRNA product Design3 comprising derived and/or modified sequence from Homo sapiens__NP_001936.1__HsHBEGF (wt)
gggagagucccgcagucggcguccagcggcucugcuuguucgugugugugucguugcaggccuuauucaagcuuaccaugaagcugcugccgucgguggugcugaagcucuuucuggcugcaguucucucggcacuggugacuggcgagagccuggagcggcuucggagagggcuagcugcuggaaccagcaacccggacccucccacuguauccacggaccagcugcuaccccuaggaggcggccgggaccggaaaguccgugacuugcaagaggcagaucuggaccuuuugagagucacuuuauccuccaagccacaagcacuggccacaccaaacaaggaggagcacgggaaaagaaagaagaaaggcaaggggcuagggaagaagagggacccaugucuucggaaauacaaggacuucugcauccauggagaaugcaaauaugugaaggagcuccgggcucccuccugcaucugccacccggguuaccauggagagaggugucaugggcugagccucccaguggaaaaucgcuuauauaccuaugaccacacaaccauccuggccgugguggcuguggugcugucaucugucugucugcuggucaucguggggcuucucauguuuagguaccauaggagaggagguuaugauguggaaaaugaagagaaagugaaguugggcaugacuaauucccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3855 - RNA, 2534 nt, Artificial Sequence
  mRNA product Design3 comprising derived and/or modified sequence from Homo sapiens__NP_000592.3__HsHGF (wt)
gggagagucccgcagucggcguccagcggcucugcuuguucgugugugugucguugcaggccuuauucaagcuuaccaugugggugaccaaacuccugccagcccugcugcugcagcauguccuccugcaucuccuccugcuccccaucgccauccccuaugcagagggacaaaggaaaagaagaaauacaauucaugaauucaaaaaaucagcaaagacuacccuaaucaaaauagauccagcacugaagauaaaaaccaaaaaagugaauacugcagaccaaugugcuaauagauguacuaggaauaaaggacuuccauucacuugcaaggcuuuuguuuuugauaaagcaagaaaacaaugccucugguuccccuucaauagcaugucaaguggagugaaaaaagaauuuggccaugaauuugaccucuaugaaaacaaagacuacauuagaaacugcaucauugguaaaggacgcagcuacaagggaacaguaucuaucacuaagaguggcaucaaaugucagcccuggaguuccaugauaccacacgaacacagcuuuuugccuucgagcuaucgggguaaagaccuacaggaaaacuacugucgaaauccucgaggggaagaagggggacccugguguuucacaagcaauccagagguacgcuacgaagucugugacauuccucaguguucagaaguugaaugcaugaccugcaauggggagaguuaucgaggucucauggaucauacagaaucaggcaagauuugucagcgcugggaucaucagacaccacaccggcacaaauucuugccugaaagauaucccgacaagggcuuugaugauaauuauugccgcaaucccgauggccagccgaggccauggugcuauacucuugacccucacacccgcugggaguacugugcaauuaaaacaugcgcugacaauacuaugaaugacacugauguuccuuuggaaacaacugaaugcauccaaggucaaggagaaggcuacaggggcacugucaauaccauuuggaauggaauuccaugucagcguugggauucucaguauccucacgagcaugacaugacuccugaaaauuucaagugcaaggaccuacgagaaaauuacugccgaaauccagaugggucugaaucacccugguguuuuaccacugauccaaacauccgaguuggcuacugcucccaaauuccaaacugugauaugucacauggacaagauuguuaucgugggaauggcaaaaauuauaugggcaacuuaucccaaacaagaucuggacuaacauguucaaugugggacaagaacauggaagacuuacaucgucauaucuucugggaaccagaugcaaguaagcugaaugagaauuacugccgaaauccagaugaugaugcucauggacccuggugcuacacgggaaauccacucauuccuugggauuauugcccuauuucucguugugaaggugauaccacaccuacaauagucaauuuagaccaucccguaauaucuugugccaaaacgaaacaauugcgaguuguaaaugggauuccaacacgaacaaacauaggauggaugguuaguuugagauacagaaauaaacauaucugcggaggaucauugauaaaggagaguuggguucuuacugcacgacaguguuucccuucucgagacuugaaagauuaugaagcuuggcuuggaauucaugauguccacggaagaggagaugagaaaugcaaacagguucucaauguuucccagcugguauauggcccugaaggaucagaucugguuuuaaugaagcuugccaggccugcuguccuggaugauuuuguuaguacgauugauuuaccuaauuauggaugcacaauuccugaaaagaccaguugcaguguuuauggcuggggcuacacuggauugaucaacuaugauggccuauuacgaguggcacaucucuauauaaugggaaaugagaaaugcagccagcaucaucgagggaaggugacucugaaugagucugaaauaugugcuggggcugaaaagauuggaucaggaccaugugagggggauuaugguggcccacuuguuugugagcaacauaaaaugagaaugguucuuggugucauuguuccuggucguggaugugccauuccaaaucguccugguauuuuuguccgaguagcauauuaugcaaaauggauacacaaaauuauuuuaacauauaagguaccacagucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3856 - RNA, 2273 nt, Artificial Sequence
  mRNA product Design3 comprising derived and/or modified sequence from Homo sapiens__NP_005336.3 __HsHSPA1A (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaaggugcuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccugggggcuucggggcucagggucccaagggagggucugggucaggccccaccauugaggagguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3857 - RNA, 2273 nt, Artificial Sequence
  mRNA product Design3 comprising derived and/or modified sequence from Homo sapiens__NP_005337.2 __HsHSPA1B (wt)
gggagagucccgcagucggcguccagcggcucugcuuguucgugugugugucguugcaggccuuauucaagcuuaccauggccaaagccgcggcgaucggcaucgaccugggcaccaccuacuccugcguggggguguuccaacacggcaagguggagaucaucgccaacgaccagggcaaccgcaccacccccagcuacguggccuucacggacaccgagcggcucaucggggaugcggccaagaaccagguggcgcugaacccgcagaacaccguguuugacgcgaagcggcugauuggccgcaaguucggcgacccgguggugcagucggacaugaagcacuggccuuuccaggugaucaacgacggagacaagcccaaggugcaggugagcuacaagggggagaccaaggcauucuaccccgaggagaucucguccauggugcugaccaagaugaaggagaucgccgaggcguaccugggcuacccggugaccaacgcggugaucaccgugccggccuacuucaacgacucgcagcgccaggccaccaaggaugcgggugugaucgcggggcucaacgugcugcggaucaucaacgagcccacggccgccgccaucgccuacggccuggacagaacgggcaagggggagcgcaacgugcucaucuuugaccugggcgggggcaccuucgacguguccauccugacgaucgacgacggcaucuucgaggugaaggccacggccggggacacccaccuggguggggaggacuuugacaacaggcuggugaaccacuucguggaggaguucaagagaaaacacaagaaggacaucagccagaacaagcgagccgugaggcggcugcgcaccgccugcgagagggccaagaggacccugucguccagcacccaggccagccuggagaucgacucccuguuugagggcaucgacuucuacacguccaucaccagggcgagguucgaggagcugugcuccgaccuguuccgaagcacccuggagcccguggagaaggcucugcgcgacgccaagcuggacaaggcccagauucacgaccugguccuggucgggggcuccacccgcauccccaaggugcagaagcugcugcaggacuucuucaacgggcgcgaccugaacaagagcaucaaccccgacgaggcuguggccuacggggcggcggugcaggcggccauccugaugggggacaaguccgagaacgugcaggaccugcugcugcuggacguggcuccccugucgcuggggcuggagacggccggaggcgugaugacugcccugaucaagcgcaacuccaccauccccaccaagcagacgcagaucuucaccaccuacuccgacaaccaacccggggugcugauccagguguacgagggcgagagggccaugacgaaagacaacaaucuguuggggcgcuucgagcugagcggcaucccuccggcccccaggggcgugccccagaucgaggugaccuucgacaucgaugccaacggcauccugaacgucacggccacggacaagagcaccggcaaggccaacaagaucaccaucaccaacgacaagggccgccugagcaaggaggagaucgagcgcauggugcaggaggcggagaaguacaaagcggaggacgaggugcagcgcgagagggugucagccaagaacgcccuggaguccuacgccuucaacaugaagagcgccguggaggaugaggggcucaagggcaagaucagcgaggcggacaagaagaagguucuggacaagugucaagaggucaucucguggcuggacgccaacaccuuggccgagaaggacgaguuugagcacaagaggaaggagcuggagcagguguguaaccccaucaucagcggacuguaccagggugccgguggucccgggccuggcggcuucggggcucagggucccaagggagggucugggucaggcccuaccauugaggagguggauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3858 - RNA, 2273 nt, Artificial Sequence
  mRNA product Design3 comprising derived and/or modified sequence from Homo sapiens__NP_005518.3 __HsHSPA1L (wt)
gggagagucccgcagucggcguccagcggcucugcuuguucgugugugugucguugcaggccuuauucaagcuuaccauggcuacugccaagggaaucgccauaggcaucgaccugggcaccaccuacuccuguguggggguguuccagcacggcaagguggagaucaucgccaacgaccagggcaaccgcaccacccccagcuacguggccuucacagacaccgagcggcucauuggggaugcggccaagaaccagguagcaaugaauccccagaacacuguuuuugaugcuaaacgucugaucggcaggaaauuuaaugauccuguuguacaagcagauaugaaacuuuggccuuuucaagugauuaaugaaggaggcaagcccaaaguccuuguguccuacaaaggggagaauaaagcuuucuacccugaggaaaucucuucgaugguauugacuaaguugaaggagacugcugaggccuuuuugggccacccugucaccaaugcagugauuaccgugccagccuauuucaaugacucucaacgucaggcuacuaaggaugcaggugugauugcuggacuuaaugugcuaagaaucaucaaugagcccacggcugcugccauugccuaugguuuagauaaaggaggucaaggagaacgacauguccugauuuuugaucuggguggaggcacauuugaugugucaauucugaccauagaugaugggauuuuugagguaaaggccacugcuggggacacucaccuggguggggaggacuuugacaacaggcuugugagccacuucguggaggaguucaagaggaaacacaaaaaggacaucagccagaacaagcgagccgugaggcggcugcgcaccgccugcgagagggccaagaggacccugucguccagcacccaggccaaccuagaaauugauucacuuuaugaaggcauugacuucuauacauccaucaccagagcucgauuugaagaguugugugcagaccuguuuagggguacccuggagccuguagaaaaagcgcuucgggaugccaagauggauaaggcuaaaauccaugacauuguuuuaguagggggcuccacccgcauccccaaggugcagcggcugcuucaggacuacuucaauggacgugaucucaacaagagcaucaacccugaugaggccguagcauauggggcugcgguacaagcagccauccugaugggggacaagucugagaagguacaggaccugcugcugcuggacguggcuccccugucccuggggcuggagacggcugggggcgugaugacugcccugauaaagcgcaacuccaccauccccaccaagcagacacagauuuucaccaccuacucugacaaccaacccggggugcugauccagguguaugagggcgagagggccaugacaaaggacaacaaccugcuggggcgguuugaccugacuggaaucccuccagcacccaggggaguuccucagaucgaggugacguuugacauugaugccaaugguauucucaaugucacagccacggacaagagcaccggcaaggugaacaagaucaccaucaccaaugacaagggccgccugagcaaggaggagauugagcgcaugguucuggaugcugagaaauauaaagcugaagaugagguccagagggagaaaauugcugcaaagaaugccuuagaauccuaugcuuuuaacaugaagaguguugugagugaugaagguuugaagggcaagauuagugagucugauaaaaauaaaauauuggauaaaugcaacgagcuccuuucguggcuggaggucaaucaacuggcagagaaagaugaguuugaucauaagagaaaggaauuggagcagauguguaacccuaucaucacaaaacucuaccaaggaggaugcacugggccugccugcggaacaggguaugugccuggaaggccugccacaggccccacaauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3859 - RNA, 2267 nt, Artificial Sequence
  mRNA product Design3 comprising derived and/or modified sequence from Homo sapiens__NP_068814.2 __HsHSPA2 (wt)
gggagagucccgcagucggcguccagcggcucugcuuguucgugugugugucguugcaggccuuauucaagcuuaccaugucugcccguggcccggcuaucggcaucgaccugggcaccaccuauucgugcgucggggucuuccaacauggcaagguggagaucaucgccaacgaccagggcaaucgcaccacccccagcuacguggccuucacggacaccgagcgccucaucggcgacgccgccaagaaccagguggccaugaaccccaccaacaccaucuucgacgccaagaggcugauuggacggaaauucgaggaugccacagugcagucggauaugaaacacuggccguuccggguggugagcgagggaggcaagcccaaagugcaaguagaguacaagggggagaccaagaccuucuucccagaggagauauccuccaugguccucacgaagaugaaggagaucgcggaagccuaccuggggggcaaggugcacagcgcggucauaacggucccggccuauuucaacgacucgcagcgccaggccaccaaggacgcaggcaccaucacggggcucaaugugcugcgcaucaucaacgagcccacggcggcggccaucgccuacggccuggacaagaagggcugcgcgggcggcgagaagaacgugcucaucuuugaccugggcgguggcacuuucgacguguccauccugaccaucgaggauggcaucuucgaggugaaguccacggccggcgacacccaccugggcggugaggacuucgacaaccgcauggugagccaccuggcggaggaguucaagcgcaagcacaagaaggacauugggcccaacaagcgcgccgugaggcggcugcgcaccgcuugcgagcgcgccaagcgcacccugagcucguccacgcaggcgagcaucgagaucgacucgcucuacgagggcguggacuucuauacguccaucacgcgcgcccgcuucgaggagcucaaugccgaccucuuucgcgggacccuggagccgguggagaaggcgcugcgcgacgccaagcuggacaagggccagauccaggagaucgugcuggugggcggcuccacucguauccccaagauccagaagcugcugcaggauuucuucaacggcaaggagcugaacaagagcaucaaccccgacgaggcgguggccuauggcgccgcggugcaggcggccauccucaucggcgacaaaucagagaaugugcaggaccugcugcuacucgacgugaccccguugucgcugggcaucgagacagcuggcggugucaugaccccacucaucaagaggaacaccacgauccccaccaagcagacgcagaccuucaccaccuacucggacaaccagagcagcguacuggugcagguauacgagggcgaacgggccaugaccaaggacaauaaccugcugggcaaguucgaccugaccgggauucccccugcgccucgcggggucccccaaaucgagguuaccuucgacauugacgccaauggcauccuuaacguuaccgccgccgacaagagcaccgguaaggaaaacaaaaucaccaucaccaaugacaaaggucgucugagcaaggacgacauugaccggauggugcaggaggcggagcgguacaaaucggaagaugaggcgaaucgcgaccgagucgcggccaaaaacgcccuggaguccuauaccuacaacaucaagcagacgguggaagacgagaaacugaggggcaagauuagcgagcaggacaaaaacaagauccucgacaagugucaggaggugaucaacuggcucgaccgaaaccagauggcagagaaagaugaguaugaacacaagcagaaagagcucgaaagaguuugcaaccccaucaucagcaaacuuuaccaaggugguccuggcggcggcagcggcggcggcgguucaggagccuccgggggacccaccaucgaagaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3860 - RNA, 2870 nt, Artificial Sequence
  mRNA product Design3 comprising derived and/or modified sequence from Homo sapiens__NP_002145.3 __HsHSPA4 (wt)
gggagagucccgcagucggcguccagcggcucugcuuguucgugugugugucguugcaggccuuauucaagcuuaccaugucgguggugggcauagaccugggcuuccagagcugcuacgucgcuguggcccgcgccggcggcaucgagacuaucgcuaaugaguauagcgaccgcugcacgccggcuugcauuucuuuugguccuaagaaucguucaauuggagcagcagcuaaaagccagguaauuucuaaugcaaagaacacaguccaaggauuuaaaagauuccauggccgagcauucucugauccauuuguggaggcagaaaaaucuaaccuugcauaugauauugugcaguugccuacaggauuaacagguauaaaggugacauauauggaggaagagcgaaauuuuaccacugagcaagugacugccaugcuuuuguccaaacugaaggagacagccgaaaguguucuuaagaagccuguaguugacuguguuguuucgguuccuuguuucuauacugaugcagaaagacgaucagugauggaugcaacacagauugcuggucuuaauugcuugcgauuaaugaaugaaaccacugcaguugcucuugcauauggaaucuauaagcaggaucuuccugccuuagaagagaaaccaagaaauguaguuuuuguagacaugggccacucugcuuaucaaguuucuguaugugcauuuaauagaggaaaacugaaaguucuggccacugcauuugacacgacauugggagguagaaaauuugaugaaguguuaguaaaucacuucugugaagaauuugggaagaaauacaagcuagacauuaaguccaaaauccgugcauuauuacgacucucucaggagugugagaaacucaagaaauugaugagugcaaaugcuucagaucucccuuugagcauugaauguuuuaugaaugauguugauguaucuggaacuaugaauagaggcaaauuucuggagaugugcaaugaucucuuagcuagaguggagccaccacuucguaguguuuuggaacaaaccaaguuaaagaaagaagauauuuaugcaguggagauaguugguggugcuacacgaaucccugcgguaaaagagaagaucagcaaauuuuucgguaaagaacuuaguacaacauuaaaugcugaugaagcugucacucgaggcugugcauugcagugugccaucuuaucgccugcuuucaaagucagagaauuuucuaucacugauguaguaccauauccaauaucucugagauggaauucuccagcugaagaagggucaagugacugugaagucuuuuccaaaaaucaugcugcuccuuucucuaaaguucuuacauuuuauagaaaggaaccuuucacucuugaggccuacuacagcucuccucaggauuugcccuauccagauccugcuauagcucaguuuucaguucagaaagucacuccucagucugauggcuccaguucaaaagugaaagucaaaguucgaguaaauguccauggcauuuucaguguguccagugcaucuuuaguggagguucacaagucugaggaaaaugaggagccaauggaaacagaucagaaugcaaaggaggaagagaagaugcaaguggaccaggaggaaccacauguugaagagcaacagcagcagacaccagcagaaaauaaggcagagucugaagaaauggagaccucucaagcuggauccaaggauaaaaagauggaccaaccaccccaagccaagaaggcaaaagugaagaccaguacuguggaccugccaaucgagaaucagcuauuauggcagauagacagagagaugcucaacuuguacauugaaaaugaggguaagaugaucaugcaggauaaacuggagaaggagcggaaugaugcuaagaacgcaguggaggaauauguguaugaaaugagagacaagcuuaguggugaauaugagaaguuugugagugaagaugaucguaacaguuuuacuuugaaacuggaagauacugaaaauugguuguaugaggauggagaagaccagccaaagcaaguuuauguugauaaguuggcugaauuaaaaaaucuaggucaaccuauuaagauacguuuccaggaaucugaagaacgaccaaaauuauuugaagaacuagggaaacagauccaacaguauaugaaaauaaucagcucuuucaaaaacaaggaggaccaguaugaucauuuggaugcugcugacaugacaaagguagaaaaaagcacaaaugaagcaauggaguggaugaauaacaagcuaaaucugcagaacaagcagaguuugaccauggauccaguugucaagucaaaagagauugaagcuaaaauuaaggagcugacaaguacuuguagcccuauaauuucaaagcccaaacccaaaguggaaccuccaaaagaggaacaaaaaaaugcagagcagaauggaccaguggauggacaaggagacaacccaggcccccaggcugcugagcaggguacagacacagcugugccuucggauucagacaagaagcuuccugaaauggacauugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3861 - RNA, 2867 nt, Artificial Sequence
  mRNA product Design3 comprising derived and/or modified sequence from Homo sapiens__NP_055093.2 __HsHSPA4L (wt)
gggagagucccgcagucggcguccagcggcucugcuuguucgugugugugucguugcaggccuuauucaagcuuaccaugucugugguuggcauugaccucggcuuucucaacugcuacauugcugucgcgagaaguggcggcaucgagaccaucgccaaugaguacagcgacagguguaccccggccuguauaucauugggaucaagaacucgagccauuggaaaugcagcaaagagccagauagucacgaacguaagaaauacaauucauggcuucaaaaagcuucaugggcgaucauuugaugaucccauugugcaaacugaaaggaucaggcuucccuaugaacugcagaaaaugccuaauggaagugcaggaguuaaggugcgguacuuagaggaagagagaccuuuugcaauugagcaaguuacuggaaugcuguuagccaagcuuaaagagacuucagaaaaugcuuugaagaaaccaguggcugacugugugauuucaauuccuagcuuuuuuacugaugccgagagaagaucugugauggcugcagcccagguugcaggcuuaaauuguuuaagguugaugaaugaaacuacugcaguugcacuggcguauggaauuuauaaacaggaucuucccccauuagaugagaaaccaagaaauguaguauuuauugauaugggacauucugccuaucaggucuugguuugugcuuuuaacaaaggaaaacuuaaagucuuggcuacuaccuuugauccauauuuggguggcaggaacuuugaugaggcuuuaguagacuacuucugugaugaguucaagaccaaauauaagauaaaugugaaagaaaacucucgggccuuguugcguuuauaucaggaaugugaaaaacuaaagaagcuaaugagugcaaaugcaucagaucuuccauugaacauugaguguuucaugaaugaccuugauguuucuaguaaaaugaacagggcucaauuugaacaacugugugcuucccuuuuggccaggguugaaccaccuuuaaaagcaguaauggaacaagcuaacuuacaacgugaagacauuaguaguauagaaauuguaggaggagcaacacgaauuccugcagugaaagaacaaaucacuaaauucuuucuuaaagacauaaguaccacauuaaaugcugaugaagcuguugcaagaggaugugcguuacagugugcgauucucucaccagcauuuaaagugcgugaauuuuccauaacagaccuuguucccuauucaaucacauuaagguggaagaccucuuuugaagauggaaguggggaaugugaaguuuucuguaagaaccauccugccccauucucaaaagucauuacuuuccacaagaaggaaccauuugaacuagaagcauuuuauacuaauuuacaugaagugccuuauccugaugcaagaauugggagcuucacuauucagaauguuuuuccacagucugauggugauaguuccaaagugaagguuaaaguucguguuaacauccauggaaucuucaguguggcuagcgcaucaguaauugagaagcaaaauuuggaaggcgaucacagugaugcuccaauggagacagaaacuucauuuaaaaaugaaaacaaagauaauauggauaaaaugcagguugaucaagaagaagggcaucaaaaaugucaugcugaacacacuccagaagaggaaauugaucauacaggagccaaaacaaagucagcugucucagacaaacaagaccgauuaaaucagacacuuaaaaaaggaaaagucaaaaguauugaucuaccgauccagaguagccuauguagacaacuaggccaagaucuucucaacagcuacauugaaaaugaggggaagaugaucaugcaagauaaguuagagaaagaaagaaaugaugcuaagaaugccguugaagaauauguauaugauuuuagagacaggcugggcacugucuaugaaaaauucaucacuccagaagacuugaguaaacugucugcaguauuggaagacacagaaaauuggcuuuaugaagacggagaggaccaaccuaaacaaguuuauguggauaagcuucaagaacuaaagaaauacggccagccuauucaaaugaaguacauggagcaugaagagagaccaaaagccuuaaaugacuugggaaaaaagauccaacuugucaugaaagugauagaagcuuauagaaacaaggaugaaagauaugaucaucuggauccuacugaaauggaaaagguugaaaaauguaucagugaugccaugaguuggcugaauaguaagaugaaugcacagaacaaacuaagucucacucaagauccugugguaaaaguuucagaaauaguagcaaagucaaaggaacuggauaauuucuguaaccccaucauuuacaagcccaaaccaaaagcagaaguuccugaagacaaaccaaaagcuaauagugaacacaauggcccaauggauggacagaguggaacugaaacuaaaucagauucaacaaaagacagcucacagcauacuaaauccucuggagagauggaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3862 - RNA, 2312 nt, Artificial Sequence
  mRNA product Design3 comprising derived and/or modified sequence from Homo sapiens__NP_005338.1__HsHSPA5 (wt)
gggagagucccgcagucggcguccagcggcucugcuuguucgugugugugucguugcaggccuuauucaagcuuaccaugaagcucucccugguggccgcgaugcugcugcugcucagcgcggcgcgggccgaggaggaggacaagaaggaggacgugggcacgguggucggcaucgaccuggggaccaccuacuccugcgucggcguguucaagaacggccgcguggagaucaucgccaacgaucagggcaaccgcaucacgccguccuaugucgccuucacuccugaaggggaacgucugauuggcgaugccgccaagaaccagcucaccuccaaccccgagaacacggucuuugacgccaagcggcucaucggccgcacguggaaugacccgucugugcagcaggacaucaaguucuugccguucaaggugguugaaaagaaaacuaaaccauacauucaaguugauauuggaggugggcaaacaaagacauuugcuccugaagaaauuucugccaugguucucacuaaaaugaaagaaaccgcugaggcuuauuugggaaagaagguuacccaugcaguuguuacuguaccagccuauuuuaaugaugcccaacgccaagcaaccaaagacgcuggaacuauugcuggccuaaauguuaugaggaucaucaacgagccuacggcagcugcuauugcuuauggccuggauaagagggagggggagaagaacauccugguguuugaccuggguggcggaaccuucgaugugucucuucucaccauugacaauggugucuucgaaguuguggccacuaauggagauacucaucuggguggagaagacuuugaccagcgugucauggaacacuucaucaaacuguacaaaaagaagacgggcaaagaugucaggaaagacaauagagcugugcagaaacuccggcgcgagguagaaaaggccaaacgggcccugucuucucagcaucaagcaagaauugaaauugaguccuucuaugaaggagaagacuuuucugagacccugacucgggccaaauuugaagagcucaacauggaucuguuccggucuacuaugaagcccguccagaaaguguuggaagauucugauuugaagaagucugauauugaugaaauuguucuuguugguggcucgacucgaauuccaaagauucagcaacugguuaaagaguucuucaauggcaaggaaccaucccguggcauaaacccagaugaagcuguagcguauggugcugcuguccaggcuggugugcucucuggugaucaagauacaggugaccugguacugcuugauguauguccccuuacacuugguauugaaacugugggaggugucaugaccaaacugauuccaaggaacacaguggugccuaccaagaagucucagaucuuuucuacagcuucugauaaucaaccaacuguuacaaucaaggucuaugaaggugaaagaccccugacaaaagacaaucaucuucuggguacauuugaucugacuggaauuccuccugcuccucguggggucccacagauugaagucaccuuugagauagaugugaaugguauucuucgagugacagcugaagacaaggguacagggaacaaaaauaagaucacaaucaccaaugaccagaaucgccugacaccugaagaaaucgaaaggaugguuaaugaugcugagaaguuugcugaggaagacaaaaagcucaaggagcgcauugauacuagaaaugaguuggaaagcuaugccuauucucuaaagaaucagauuggagauaaagaaaagcugggagguaaacuuuccucugaagauaaggagaccauggaaaaagcuguagaagaaaagauugaauggcuggaaagccaccaagaugcugacauugaagacuucaaagcuaagaagaaggaacuggaagaaauuguucaaccaauuaucagcaaacucuauggaagugcaggcccucccccaacuggugaagaggauacagcagaaaaagaugaguuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3863 - RNA, 2279 nt, Artificial Sequence
  mRNA product Design3 comprising derived and/or modified sequence from Homo sapiens__NP_002146.2__HsHSPA6 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccggguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccgccuauuucaaugacucgcagcgccaggccaccaaggacgcgggggccaucgcggggcucaacguguugcggaucaucaaugagcccacggcagcugccaucgccuaugggcuggaccggcggggcgcgggagagcgcaacgugcucauuuuugaccugggugggggcaccuucgaugugucgguucucuccauugacgcuggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcacccuguccuccagcacccaggccacccuggagauagacucccuguucgagggcguggacuucuacacguccaucacucgugcccgcuuugaggaacugugcucagaccucuuccgcagcacccuggagccgguggagaaggcccugcgggaugccaagcuggacaaggcccagauucaugacgucguccugguggggggcuccacacgcauccccaaggugcagaaguugcugcaggacuucuucaacggcaaggagcugaacaagagcaucaacccugaugaggcuguggccuauggggcugcugugcaggcggccguguugaugggggacaaaugugagaaagugcaggaucuccugcugcuggauguggcuccccugucucuggggcuggagacagcagguggggugaugaccacgcugauccagaggaacgccacuauccccaccaagcagacccagacuuucaccaccuacucggacaaccagccuggggucuucauccagguguaugagggugagagggccaugaccaaggacaacaaccugcuggggcguuuugaacucaguggcaucccuccugccccacguggagucccccagauagaggugacuuuugacauugaugcuaauggcauccugagcgugacagccacugacaggagcacagguaaggcuaacaagaucaccaucaccaaugacaagggccggcugagcaaggaggagguggagaggaugguucaugaagccgagcaguacaaggcugaggaugaggcccagagggacagaguggcugccaaaaacucgcuggaggcccaugucuuccaugugaaagguucuuugcaagaggaaagccuuagggacaagauucccgaagaggacaggcgcaaaaugcaagacaagugucgggaaguccuugccuggcuggagcacaaccagcuggcagagaaggaggaguaugagcaucagaagagggagcuggagcaaaucugucgccccaucuucuccaggcucuauggggggccuggugucccugggggcagcaguuguggcacucaagcccgccagggggaccccagcaccggccccaucauugaggagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3864 - RNA, 1451 nt, Artificial Sequence
  mRNA product Design3 comprising derived and/or modified sequence from Homo sapiens__P48741__HsHSPA7 (wt)
gggagagucccgcagucggcguccagcggcucugcuuguucgugugugugucguugcaggccuuauucaagcuuaccaugcaggccccacgggagcucgcggugggcaucgaccugggcaccaccuacucgugcgugggcguguuucagcagggccgcguggagauccuggccaacgaccagggcaaccgcaccacgcccagcuacguggccuucaccgacaccgagcggcuggucggggacgcggccaagagccaggcggcccugaacccccacaacaccguguucgaugccaagcggcugaucgggcgcaaguucgcggacaccacggugcagucggacaugaagcacuggcccuuccagguggugagcgagggcggcaagcccaaggugcgcguaugcuaccgcggggaggacaagacguucuaccccgaggagaucucguccauggugcugagcaagaugaaggagacggccgaggcguaccugggccagcccgugaagcacgcagugaucaccgugcccaccuauuucaguaacucgcagcgccaggccaccaaggacgcgggggccaucgcggggcucaaggugcugccgaucaucaaugaggccacggcagcagccaucgccuaugggcuggaccggcggggcgcgggaaagcgcaacgugcucauuuuugaccugggugggggcaccuucgaugugucgguucucuccauugacgccggugucuuugaggugaaagccacugcuggagauacccaccugggaggagaggacuucgacaaccggcucgugaaccacuucauggaagaauuccggcggaagcaugggaaggaccugagcgggaacaagcgugcccugcgcaggcugcgcacagccugugagcgcgccaagcgcaccccguccuccagcacccaggccacccuggagauagacucccuguucgagggcguggacuucuacaaguccaucacucgugcccgcuuugaggaacugugcucagaccucuuccgcagcacccuggagccgguggagaaggcccugcgggaugccaagcuggacaaggcccagauucaugacuucguccuggggggagggcuccacucgcauccccaaggugcagaaguugcugcaggacuucuucaacggcaaggagcugaacaagagcaucaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3865 - RNA, 2288 nt, Artificial Sequence
  mRNA product Design3 comprising derived and/or modified sequence from Homo sapiens__NP_006588.1 __HsHSPA8 (wt)
gggagagucccgcagucggcguccagcggcucugcuuguucgugugugugucguugcaggccuuauucaagcuuaccauguccaagggaccugcaguugguauugaucuuggcaccaccuacucuuguguggguguuuuccagcacggaaaagucgagauaauugccaaugaucagggaaaccgaaccacuccaagcuaugucgccuuuacggacacugaacgguugaucggugaugccgcaaagaaucaaguugcaaugaaccccaccaacacaguuuuugaugccaaacgucugauuggacgcagauuugaugaugcuguuguccagucugauaugaaacauuggcccuuuaugguggugaaugaugcuggcaggcccaagguccaaguagaauacaagggagagaccaaaagcuucuauccagaggaggugucuucuaugguucugacaaagaugaaggaaauugcagaagccuaccuugggaagacuguuaccaaugcuguggucacagugccagcuuacuuuaaugacucucagcgucaggcuaccaaagaugcuggaacuauugcuggucucaauguacuuagaauuauuaaugagccaacugcugcugcuauugcuuacggcuuagacaaaaagguuggagcagaaagaaacgugcucaucuuugaccugggagguggcacuuuugaugugucaauccucacuauugaggauggaaucuuugaggucaagucuacagcuggagacacccacuuggguggagaagauuuugacaaccgaauggucaaccauuuuauugcugaguuuaagcgcaagcauaagaaggacaucagugagaacaagagagcuguaagacgccuccguacugcuugugaacgugcuaagcguacccucucuuccagcacccaggccaguauugagaucgauucucucuaugaaggaaucgacuucuauaccuccauuacccgugcccgauuugaagaacugaaugcugaccuguuccguggcacccuggacccaguagagaaagcccuucgagaugccaaacuagacaagucacagauucaugauauuguccugguuggugguucuacucguauccccaagauucagaagcuucuccaagacuucuucaauggaaaagaacugaauaagagcaucaacccugaugaagcuguugcuuauggugcagcuguccaggcagccaucuugucuggagacaagucugagaauguucaagauuugcugcucuuggaugucacuccucuuucccuugguauugaaacugcugguggagucaugacuguccucaucaagcguaauaccaccauuccuaccaagcagacacagaccuucacuaccuauucugacaaccagccuggugugcuuauucagguuuaugaaggcgagcgugccaugacaaaggauaacaaccugcuuggcaaguuugaacucacaggcauaccuccugcaccccgagguguuccucagauugaagucacuuuugacauugaugccaaugguauacucaaugucucugcuguggacaagaguacgggaaaagagaacaagauuacuaucacuaaugacaagggccguuugagcaaggaagacauugaacguaugguccaggaagcugagaaguacaaagcugaagaugagaagcagagggacaaggugucauccaagaauucacuugaguccuaugccuucaacaugaaagcaacuguugaagaugagaaacuucaaggcaagauuaacgaugaggacaaacagaagauucuggacaaguguaaugaaauuaucaacuggcuugauaagaaucagacugcugagaaggaagaauuugaacaucaacagaaagagcuggagaaaguuugcaaccccaucaucaccaagcuguaccagagugcaggaggcaugccaggaggaaugccugggggauuuccuggugguggagcuccucccucugguggugcuuccucagggcccaccauugaagagguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3866 - RNA, 2387 nt, Artificial Sequence
  mRNA product Design3 comprising derived and/or modified sequence from Homo sapiens__NP_004125.3 __HsHSPA9 (wt)
gggagagucccgcagucggcguccagcggcucugcuuguucgugugugugucguugcaggccuuauucaagcuuaccaugauaagugccagccgagcugcagcagcccgucucgugggcgccgcagccucccggggcccuacggccgcccgccaccaggauagcuggaauggccuuagucaugaggcuuuuagacuuguuucaaggcgggauuaugcaucagaagcaaucaagggagcaguuguugguauugauuuggguacuaccaacuccugcguggcaguuauggaagguaaacaagcaaaggugcuggagaaugccgaaggugccagaaccaccccuucaguuguggccuuuacagcagauggugagcgacuuguuggaaugccggccaagcgacaggcugucaccaacccaaacaauacauuuuaugcuaccaagcgucucauuggccggcgauaugaugauccugaaguacagaaagacauuaaaaauguucccuuuaaaauuguccgugccuccaauggugaugccuggguugaggcucaugggaaauuguauucuccgagucagauuggagcauuuguguugaugaagaugaaagagacugcagaaaauuacuuggggcacacagcaaaaaaugcugugaucacagucccagcuuauuucaaugacucgcagagacaggccacuaaagaugcuggccagauaucuggacugaaugugcuucgggugauuaaugagcccacagcugcugcucuugccuauggucuagacaaaucagaagacaaagucauugcuguauaugauuuaggugguggaacuuuugauauuucuauccuggaaauucagaaaggaguauuugaggugaaauccacaaauggggauaccuucuuagguggggaagacuuugaccaggccuugcuacggcacauugugaaggaguucaagagagagacagggguugauuugacuaaagacaacauggcacuucagaggguacgggaagcugcugaaaaggcuaaaugugaacucuccucaucugugcagacugacaucaauuugcccuaucuuacaauggauucuucuggacccaagcauuugaauaugaaguugacccgugcucaauuugaagggauugucacugaucuaaucagaaggacuaucgcuccaugccaaaaagcuaugcaagaugcagaagucagcaagagugacauaggagaagugauucuuguggguggcaugacuaggaugcccaagguucagcagacuguacaggaucuuuuuggcagagccccaaguaaagcugucaauccugaugaggcuguggccauuggagcugccauucagggagguguguuggccggcgaugucacggaugugcugcuccuugaugucacuccccugucucuggguauugaaacucuaggaggugucuuuaccaaacuuauuaauaggaauaccacuauuccaaccaagaagagccagguauucucuacugccgcugauggucaaacgcaaguggaaauuaaagugugucagggugaaagagagauggcuggagacaacaaacuccuuggacaguuuacuuugauuggaauuccaccagccccucguggaguuccucagauugaaguuacauuugacauugaugccaaugggauaguacauguuucugcuaaagauaaaggcacaggacgugagcagcagauuguaauccagucuucugguggauuaagcaaagaugauauugaaaauaugguuaaaaaugcagagaaauaugcugaagaagaccggcgaaagaaggaacgaguugaagcaguuaauauggcugaaggaaucauucacgacacagaaaccaagauggaagaauucaaggaccaauuaccugcugaugagugcaacaagcugaaagaagagauuuccaaaaugagggagcuccuggcuagaaaagacagcgaaacaggagaaaauauuagacaggcagcauccucucuucagcaggcaucacugaagcuguucgaaauggcauacaaaaagauggcaucugagcgagaaggcucuggaaguucuggcacuggggaacaaaaggaagaucaaaaggaggaaaaacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3867 - RNA, 2375 nt, Artificial Sequence
  mRNA product Design3 comprising derived and/or modified sequence from Homo sapiens__NP_079291.2__HsHSPA12A (wt)
gggagagucccgcagucggcguccagcggcucugcuuguucgugugugugucguugcaggccuuauucaagcuuaccauggcggacaaggaggccggcggcagcgacgggccccgagaaacggcucccacaucugcauauucaucuccagcccggagucuuggggacacaggaauaacgccucugucccccucccauauugugaacgacacugacuccaacgucucagaacagcagucauuucucguggugguggccgucgacuuugggaccacauccaguggcuaugccuacagcuucaccaaggagccggaaugcauccaugugaugaggcgaugggagggaggugacccugguguguccaaucagaagacuccaaccaccaucuugcugacucccgagaggaaguuccacagcuucggguaugccgccagggacuuuuaccaugaccuggaucccaaugaggccaagcaguggcuguaccuggagaaguucaagaugaagcugcacaccacuggggaccucaccauggauacagaccugacggcagcaaauggcaagaaagucaaagcccuugaaaucuuugcuuaugcccugcaguacuuuaaggagcaggcgcugaaggagcugagugaccaggcggguucggaguucgagaacucugaugucagaugggucaucacggugccugccaucuggaagcagccggccaagcaguucaugagacaagcugccuaccaggcaggccuggccucccccgagaacucggagcagcucaucauugccuuggagccugaggcagccucuaucuacugccgaaagcugcggcuacaccagaugauugagcugagcagcaaggcagccgucaauggguacagcggcagugacacaguaggagcuggguuuacacaggcuaaggaacacauacggcguaaucggcagagucggaccuuuuugguggagaaugucauaggagaaaucugguccgagcuggaggaaggugauaaguaugugguuguggacaguggcgguggcaccguagaccugacaguccaucagauccgguuaccggagggacaccuuaaggaacuguauaaagcaacaggcggacccuauggaucuuuaggaguagauuaugaguucgaaaaacuucuguauaaaauauuuggagaggauuuuauugaacaauucaaaaucaaacgcccugcagccuggguugacuuaaugauugcguuugagucucgcaaaagggcggcugccccagacagaacuaacccgcugaacaucacccugcccuucuccuucauugacuacuacaagaaguuccgcgggcacaguguggagcacgccuugcggaaaagcaauguggauuuugugaagugguccucgcaggggaugcugcggaugaguccagaugccaugaacgcccuuuuuaagccgaccaucgauagcaucauugagcaucuccgggaccuguuucagaagcccgagguguccaccgucaaguuccucuuucuggugggcggcuuugccgaggcgccccugcugcagcaggcggugcaggcugcuuuuggggaccagugccggaucaucaucccccaggacgugggccucaccauccucaagggugccguccucuuuggccuggaccccgcggucaucaaggugcgccggucgccgcucaccuacgggguaggcgugcugaaccgcuacguggagggcaagcacccgccugagaagcugcuggugaaggauggcacucgguggugcaccgacgucuuugacaaguucaucucugccgaccagucuguggcucugggugagcuggucaagcguagcuacaccccggccaagcccucccagcuggucauugucaucaacaucuacagcucugagcacgacaacgucagcuucaucacugaucccggggugaagaaguguggcacgcuccgccuggaucucacagggaccaguggcacugcggugcccgcccggagggagauccagacccuuaugcaguucggggacaccgagaucaaagccacagccauugauauagccacuucgaagagugucaaaguugggaucgacuucuuaaauuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3868 - RNA, 2408 nt, Artificial Sequence
  mRNA product Design3 comprising derived and/or modified sequence from Homo sapiens__NP_443202.3 __HsHSPA12B (wt)
gggagagucccgcagucggcguccagcggcucugcuuguucgugugugugucguugcaggccuuauucaagcuuaccauguuggcugucccggagaugggccugcaggggcuguacaucggcuccagcccggagcgguccccagugccuagcccacccggcuccccgaggacccaggaaagcugcggcauugccccccucacacccucgcagucuccaaaacccgagguccgagccccccagcaggccuccuucucuguggugguggccauugacuucggcaccacgucuaguggcuaugcuuucagcuuugccagugacccugaggccauccacaugaugaggaaaugggagggcggagacccgggcguggcccaccagaagaccccgaccugccugcugcugacuccggagggcgccuuccacagcuuuggcuacaccgcccgcgauuacuaccaugaccuggaccccgaagaggcgcgggacuggcucuacuucgagaaguucaagaugaagauccacagcgccacggaucucaccuugaagacccagcuagaggcaguaaauggaaagacgaugcccgcccuggagguguucgcccaugcccugcgcuucuucagggagcacgcccuucaggagcugagggagcagagcccaucgcugccagagaaggacacugugcgcuggguguugacggugccugccaucuggaaacagccagccaagcaguucaugcgggaggcugccuaccuggcuggacuagugucccgagagaaugcagagcagcuacucaucgcccuggagcccgaggccgccucgguauacugccgcaagcugcgccugcaccagcuccuggaccugaguggccgggccccagguggugggcgccugggugagcgccgcuccaucgacuccagcuuccgucaggcucgggagcagcugcgaaggucccgccacagccgcacguuccugguggagucaggcguaggagagcugugggcagagaugcaagcaggagaccgcuacgugguggccgacugcggcggaggcaccguggaccugacggugcaccagcuggagcagccccauggcacccucaaggagcucuacaaggcaucugggggcccuuauggcgcggugggcguggaccuggccuucgagcagcugcugugccgcaucuucggcgaggacuucaucgccaccuucaaaaggcaacggccggcagccuggguagaucugaccaucgccuucgaggcucgcaagcgcacugcuggcccacaccgugcaggggcgcucaacaucucgcugcccuucuccuucauugacuucuaccgcaagcagcggggccacaacguggagaccgcucugcgcaggagcagcgugaacuucgugaagugguccucacaggggaugcuccgaaugucuugugaagccaugaacgagcucuuucagcccaccgucagcgggaucauccagcacauagaggcccugcuggcacggccggaggugcagggugugaagcugcuguuccuagugggcggcuucgccgagucagcggugcugcagcacgcggugcaggcggcgcugggcgcccgcggucugcgugucguggucccgcacgacgugggccucaccauccucaaaggcgcggugcuguucggccaggcgccgggcguggugcggguccgccgcucgccgcucaccuauggcgugggcgugcucaaccgcuuugugccugggcgccacccgcccgaaaagcugcugguucgcgacggccgccgcuggugcaccgacgucuucgagcgcuucguggccgccgagcagucgguggcccugggcgaggaggugcggcgcagcuacugcccggcgcgucccggccagcggcgcguacucaucaaccuguacugcugcgcggcagaggaugcgcgcuucaucaccgaccccggcgugcgcaaaugcggcgcgcucagccucgagcuugagcccgccgacugcggccaggacaccgccggcgcgccucccggccgccgcgagauccgcgccgccaugcaguuuggcgacaccgaaauuaaggucaccgccgucgacgucagcaccaaucgcuccgugcgcgcguccaucgacuuucuuuccaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3869 - RNA, 1763 nt, Artificial Sequence
  mRNA product Design3 comprising derived and/or modified sequence from Homo sapiens__NP_008879.3__HsHSPA13 (wt)
gggagagucccgcagucggcguccagcggcucugcuuguucgugugugugucguugcaggccuuauucaagcuuaccauggccagagagaugacgaucuuaggaucggcuguuuugacucuccuguuggccggcuauuuggcacaacaguauuuaccauugccuacuccuaaagugauugguauugaucuuggcaccaccuauuguucuguugggguguuuuuuccuggcacaggaaaaguaaaggugauuccagaugaaaaugggcauaucagcauacccagcauggugucuuuuacugacaaugauguauaugugggauaugaaagcguagagcuggcagauucaaauccucaaaacacaauauaugaugccaaaagauucauaggcaagauuuuuaccgcagaagaguuggaggcugaaauuggcagauacccauuuaagguuuuaaacaaaaauggaaugguugaguuuucugugacaaguaaugagaccaucacaguguccccagaauauguuggcucucgacuauuguugaaguuaaaggaaauggcagaggcauaucuuggaaugccaguugccaaugcugucauuucuguaccagcagaauuugaucuaaaacagagaaauucaacaauugaagcugcuaaccuugcaggacugaagauuuugaggguaauaaaugaacccacagcagcagcuauggccuauggucuccacaaggcugacgucuuccacgucuuggugauagacuugggcggaggaacucuagaugugucuuuacugaauaaacaaggagggauguuucuaacccgagcaaugucuggaaacaauaaacuuggaggacaggacuucaaucagagauugcuucaguacuuauauaaacagaucuaucaaacauauggcuucgugcccucuaggaaagaggaaauccacagauugagacaagcuguggaaauggucaaauuaaaucugacucuucaucaaucugcucaguugucaguauuacuaacgguggaggagcaggacaggaaggaaccucacaguagugacacugaacugccaaaagacaaacuuuccucagcagaugaccaucgcgugaacaguggguuuggacguggccuuucugauaagaaaaguggagaaagucagguuuuauuugaaacagaaauaucacggaaacucuuugauacccuuaaugaagaccucuuucagaaaauacugguacccauucagcaaguauugaaagaaggccaccuggaaaagacugagauugaugaggugguuuuaguugggggcuccacucguauuccucggauccgucaagucauucaagaguucuuuggaaaagaucccaacacaucuguagacccugaccuagcaguaguaacgggaguggcuauccaagcagggauugauggaggcucuuggccucuccaagucagugcuuuagaaauucccaauaagcauuuacaaaaaaccaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3870 - RNA, 1877 nt, Artificial Sequence
  mRNA product Design3 comprising derived and/or modified sequence from Homo sapiens__NP_057383.2__HsHSPA14 (wt)
gggagagucccgcagucggcguccagcggcucugcuuguucgugugugugucguugcaggccuuauucaagcuuaccauggcggccaucggaguucaccugggcugcaccucagccuguguggccgucuauaaggauggccgggcuggugugguugcaaaugaugccggugaccgaguuacuccagcuguuguugcuuacucagaaaaugaagagauuguuggauuggcagcaaaacaaaguagaauaagaaauauuucaaauacaguaaugaaaguaaagcagauccugggcagaagcuccagugauccacaagcucagaaauacaucgcggaaaguaaauguuuagucauugaaaaaaaugggaaauuacgauaugaaauagauacuggagaagaaacaaaauuuguuaacccagaagauguugccagacugauauuuaguaaaaugaaagaaacggcacauucuguauugggcucagaugcaaaugauguaguuauuacugucccguuugauuuuggagaaaagcaaaaaaaugcucuuggagaagcagcuagagcugcuggauuuaauguuuugcgauuaauucacgaaccgucugcagcucuucuugcuuauggaauuggacaagacuccccuacuggaaaaagcaauauuuugguguuuaagcuuggaggaacauccuuaucucucagcgucauggaaguuaacaguggaauauaucggguucuuucaacaaacacugaugauaacaucgguggugcacauuucacagaaaccuuagcacaguaucuagcuucugaguuccaaagauccuucaaacaugaugugagaggaaaugcgcgagccaugaugaaauuaacgaacagugcugaaguagcgaaacauucuuugucaaccuugggaagugccaacuguuuucuugacucauuauaugaaggucaagauuuugauugcaauguguccagagcaagauuugaacuucuuuguucuccacuuuuuaauaaguguauagaagcaaucagaggacucuuagaucaaaauggauuuacagcagaugauaucaacaagguuguccuuuguggagggucuucucgaaucccaaagcuacagcaacugauuaaagaucuuuucccagcuguugagcuucucaauucuaucccuccugaugaagugaucccuauuggugcagcuauagaagcaggaauucuuauugggaaagaaaaccuguugguggaagacucucuuaugauagaguguucagccagagauauuuuaguuaaggguguggacgaaucaggagccaguagauucacagugcuguuuccaucagggacuccuuugccagcucgaagacaacacacauugcaagccccuggaagcauaucuucagugugccuugaacucuaugagucugaugggaagaacucugccaaagaggaaaccaaguuugcacagguuguacuccaggauuuagauaaaaaagaaaauggauuacgugauauauuagcuguucuuacuaugaaaagggauggaucuuuacaugugacaugcacagaucaagaaacuggaaaaugugaagcaaucucuauugagauagcaucuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3871 - RNA, 2924 nt, Artificial Sequence
  mRNA product Design3 comprising derived and/or modified sequence from Homo sapiens__NP_006635.2 __HsHSPH1 (wt)
gggagagucccgcagucggcguccagcggcucugcuuguucgugugugugucguugcaggccuuauucaagcuuaccaugucgguggugggguuggacgugggcucgcagagcugcuacaucgcgguagcccgggccgggggcaucgagaccaucgccaaugaguucagcgaccggugcaccccgucagucauaucauuuggaucaaaaaauagaacaaucggaguugcagccaaaaaucagcaaaucacucaugcaaacaauacggugucuaacuucaaaagauuucauggccgagcauucaaugaccccuucauucaaaaggagaaggaaaacuugaguuacgauuugguuccauugaaaaaugguggaguuggaauaaagguaauguacaugggugaagaacaucuauuuaguguggagcagauaacagccauguuguugacuaagcugaaggaaacugcugaaaacagccucaagaaaccaguaacagauuguguuauuucaguccccuccuucuuuacagaugcugagaggcgaucuguguuagaugcugcacagauuguuggccuaaacuguuuaagacuuaugaaugacaugacagcuguugcuuugaauuacggaauuuauaagcaggaucucccaagccuggaugagaaaccucggauagugguuuuuguugauaugggacauucagcuuuucaagugucugcuugugcuuuuaacaagggaaaauugaagguacugggaacagcuuuugauccuuucuuaggaggaaaaaacuucgaugaaaaguuaguggaacauuuuugugcagaauuuaaaacuaaguacaaguuggaugcaaaauccaaaauacgagcacuccuacgucuguaucaggaaugugaaaaacugaaaaagcuaaugagcucuaacagcacagaccuuccacugaauaucgaaugcuuuaugaaugauaaagauguuuccggaaagaugaacaggucacaauuugaagaacucugugcugaacuucugcaaaagauagaaguaccccuuuauucacuguuggaacaaacucaucucaaaguagaagaugugagugcaguugagauuguuggaggcgcuacacgaauuccagcugugaaggaaagaauugccaaauucuuuggaaaagauauuagcacaacacucaaugcagaugaagcaguagccagaggaugugcauuacagugugcaauacuuuccccggcauuuaaaguuagagaauuuuccgucacagaugcaguuccuuuuccaauaucucugaucuggaaccaugauucagaagauacugaagguguucaugaagucuuuagucgaaaccaugcugcuccuuucuccaaaguucucaccuuucugagaagggggccuuuugagcuagaagcuuucuauucugauccccaaggaguuccauauccagaagcaaaaauaggccgcuuuguaguucagaauguuucugcacagaaagauggagaaaaaucuagaguaaaagucaaagugcgagucaacacccauggcauuuucaccaucucuacggcaucuaugguggagaaagucccaacugaggagaaugaaaugucuucugaagcugacauggagugucugaaucagagaccaccagaaaacccagacacugauaaaaauguccagcaagacaacagugaagcuggaacacagccccagguacaaacugaugcucaacaaaccucacagucucccccuucaccugaacuuaccucagaagaaaacaaaaucccagaugcugacaaagcaaaugaaaaaaaaguugaccagccuccagaagcuaaaaagcccaaaauaaagguggugaauguugagcugccuauugaagccaacuuggucuggcaguuagggaaagaccuucuuaacauguauauugagacagaggguaagaugauaaugcaagauaaauuggaaaaagaaaggaaugaugcuaaaaaugcaguugaggaauauguguaugaguucagagacaagcuguguggaccauaugaaaaauuuauaugugagcaggaucaucaaaauuuuuugagacuccucacagaaacugaagacuggcuguaugaagaaggagaggaccaagcuaaacaagcauauguugacaaguuggaagaauuaaugaaaauuggcacuccaguuaaaguucgguuucaggaagcugaagaacggccaaaaauguuugaagaacuaggacagaggcugcagcauuaugccaagauagcagcugacuucagaaauaaggaugagaaauacaaccauauugaugagucugaaaugaaaaaaguggagaagucuguuaaugaagugauggaauggaugaauaaugucaugaaugcucaggcuaaaaagagucuugaucaggauccaguuguacgugcucaggaaauuaaaacaaaaaucaaggaauugaacaacacaugugaacccguuguaacacaaccgaaaccaaaaauugaaucacccaaacuggaaagaacuccaaauggcccaaauauugauaaaaaggaagaagauuuagaagacaaaaacaauuuuggugcugaaccuccacaucagaauggugaauguuacccuaaugagaaaaauucuguuaauauggacuuggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3872 - RNA, 3347 nt, Artificial Sequence
  mRNA product Design3 comprising derived and/or modified sequence from Homo sapiens__NP_006380.1 __HsHYOU1 (wt)
gggagagucccgcagucggcguccagcggcucugcuuguucgugugugugucguugcaggccuuauucaagcuuaccauggcagacaaaguuaggaggcagaggccgaggaggcgagucuguugggccuugguggcugugcucuuggcagaccuguuggcacugagugauacacuggcagugaugucuguggaccugggcagugaguccaugaagguggccauugucaaaccuggagugcccauggaaauugucuugaauaaggaaucucggaggaaaacaccggugaucgugacccugaaagaaaaugaaagauucuuuggagacagugcagcaagcauggcgauuaagaauccaaaggcuacgcuacguuacuuccagcaccuccuggggaagcaggcagauaacccccauguagcucuuuaccaggcccgcuucccggagcacgagcugacuuucgacccacagaggcagacugugcacuuucagaucagcucgcagcugcaguucucaccugaggaaguguugggcaugguucucaauuauucucguucucuagcugaagauuuugcagagcagcccaucaaggaugcagugaucaccgugccagucuucuucaaccaggccgagcgccgagcugugcugcaggcugcucguauggcuggccucaaagugcugcagcucaucaaugacaacaccgccacugcccucagcuauggugucuuccgccggaaagauauuaacaccacugcccagaauaucauguucuaugacaugggcucaggcagcaccguaugcaccauugugaccuaccagauggugaagacuaaggaagcugggaugcagccacagcugcagauccggggaguaggauuugaccguacccuggggggccuggagauggagcuccggcuucgagaacgccuggcugggcuuuucaaugagcagcgcaagggucagagagcaaaggaugugcgggagaacccgcgugccauggccaagcugcugcgugaggcuaaucggcucaaaaccguccucagugccaacgcugaccacauggcacagauugaaggccugauggaugauguggacuucaaggcaaaagugacucguguggaauuugaggaguugugugcagacuuguuugagcgggugccugggccuguacagcaggcccuccagagugccgaaaugagucuggaugagauugagcaggugauccugguggguggggccacucggguccccagaguucaggaggugcugcugaaggccgugggcaaggaggagcuggggaagaacaucaaugcagaugaagcagccgccaugggggcaguguaccaggcagcugcgcucagcaaagccuuuaaagugaagccauuugucguccgagaugcaguggucuaccccauccugguggaguucacgagggagguggaggaggagccugggauucacagccugaagcacaauaaacggguacucuucucucggauggggcccuacccucaacgcaaagucaucaccuuuaaccgcuacagccaugauuucaacuuccacaucaacuacggcgaccugggcuuccuggggccugaagaucuucggguauuuggcucccagaaucugaccacagugaagcuaaaaggggugggugacagcuucaagaaguauccugacuacgaguccaagggcaucaaggcucacuucaaccuggaugagaguggcgugcucagucuagacaggguggagucuguauuugagacacugguagaggacagcgcagaagaggaaucuacucucaccaaacuuggcaacaccauuuccagccuguuuggaggcgguaccacaccagaugccaaggagaaugguacugauacuguccaggaggaagaggagagcccugcagaggggagcaaggacgagccuggggagcagguggagcucaaggaggaagcugaggccccaguggaggauggcucucagcccccacccccugaaccuaagggagaugcaaccccugagggagaaaaggccacagaaaaagaaaauggggacaagucugaggcccagaaaccaagugagaaggcagaggcagggccugagggcgucgcuccagccccagagggagagaagaagcagaagcccgccaggaagcggcgaaugguagaggagaucgggguggagcugguuguucuggaccugccugacuugccagaggauaagcuggcucagucggugcagaaacuucaggacuugacacuccgagaccuggagaagcaggaacgggaaaaagcugccaacagcuuggaagcauucauauuugagacccaggacaagcuguaccagcccgaguaccaggaaguguccacagaggagcagcgugaggagaucucugggaagcucagcgccgcauccaccuggcuggaggaugaggguguuggagccaccacagugauguugaaggagaagcuggcugagcugaggaagcugugccaagggcuguuuuuucggguagaggagcgcaagaaguggcccgaacggcugucugcccucgauaaucuccucaaccauuccagcauguuccucaagggggcccggcucaucccagagauggaccagaucuucacugagguggagaugacaacguuagagaaagucaucaaugagaccugggccuggaagaaugcaacucuggccgagcaggcuaagcugcccgccacagagaagccuguguugcucucaaaagacauugaagcuaagaugauggcccuggaccgagaggugcaguaucugcucaauaaggccaaguuuaccaagccccggccccggccuaaggacaagaaugggacccgggcagagccaccccucaaugccagugccagugaccagggggagaaggucaucccuccagcaggccagacugaagaugcagagcccauuucagaaccugagaaaguagagacuggauccgagccaggagacacugagccuuuggaguuaggagguccuggagcagaaccugaacagaaagaacaaucgacaggacagaagcggccuuugaagaacgacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3873 - RNA, 2546 nt, Artificial Sequence
  mRNA product Design3 comprising derived and/or modified sequence from Homo sapiens__NP_005339.3 __HsHSP90AA1 (wt)
gggagagucccgcagucggcguccagcggcucugcuuguucgugugugugucguugcaggccuuauucaagcuuaccaugccugaggaaacccagacccaagaccaaccgauggaggaggaggagguugagacguucgccuuucaggcagaaauugcccaguugaugucauugaucaucaauacuuucuacucgaacaaagagaucuuucugagagagcucauuucaaauucaucagaugcauuggacaaaauccgguaugaaagcuugacagaucccaguaaauuagacucugggaaagagcugcauauuaaccuuauaccgaacaaacaagaucgaacucucacuauuguggauacuggaauuggaaugaccaaggcugacuugaucaauaaccuugguacuaucgccaagucugggaccaaagcguucauggaagcuuugcaggcuggugcagauaucucuaugauuggccaguucgguguugguuuuuauucugcuuauuugguugcugagaaaguaacugugaucaccaaacauaacgaugaugagcaguacgcuugggaguccucagcagggggaucauucacagugaggacagacacaggugaaccuaugggucguggaacaaaaguuauccuacaccugaaagaagaccaaacugaguacuuggaggaacgaagaauaaaggagauugugaagaaacauucucaguuuauuggauaucccauuacucuuuuuguggagaaggaacgugauaaagaaguaagcgaugaugaggcugaagaaaaggaagacaaagaagaagaaaaagaaaaagaagagaaagagucggaagacaaaccugaaauugaagauguugguucugaugaggaagaagaaaagaaggauggugacaagaagaagaagaagaagauuaaggaaaaguacaucgaucaagaagagcucaacaaaacaaagcccaucuggaccagaaaucccgacgauauuacuaaugaggaguacggagaauucuauaagagcuugaccaaugacugggaagaucacuuggcagugaagcauuuuucaguugaaggacaguuggaauucagagcccuucuauuugucccacgacgugcuccuuuugaucuguuugaaaacagaaagaaaaagaacaacaucaaauuguauguacgcagaguuuucaucauggauaacugugaggagcuaaucccugaauaucugaacuucauuagaggggugguagacucggaggaucucccucuaaacauaucccgugagauguugcaacaaagcaaaauuuugaaaguuaucaggaagaauuuggucaaaaaaugcuuagaacucuuuacugaacuggcggaagauaaagagaacuacaagaaauucuaugagcaguucucuaaaaacauaaagcuuggaauacacgaagacucucaaaaucggaagaagcuuucagagcuguuaagguacuacacaucugccucuggugaugagaugguuucucucaaggacuacugcaccagaaugaaggagaaccagaaacauaucuauuauaucacaggugagaccaaggaccagguagcuaacucagccuuuguggaacgucuucggaaacauggcuuagaagugaucuauaugauugagcccauugaugaguacuguguccaacagcugaaggaauuugaggggaagacuuuagugucagucaccaaagaaggccuggaacuuccagaggaugaagaagagaaaaagaagcaggaagagaaaaaaacaaaguuugagaaccucugcaaaaucaugaaagacauauuggagaaaaaaguugaaaaggugguugugucaaaccgauuggugacaucuccaugcuguauugucacaagcacauauggcuggacagcaaacauggagagaaucaugaaagcucaagcccuaagagacaacucaacaauggguuacauggcagcaaagaaacaccuggagauaaacccugaccauuccauuauugagaccuuaaggcaaaaggcagaggcugauaagaacgacaagucugugaaggaucuggucaucuugcuuuaugaaacugcgcuccugucuucuggcuucagucuggaagauccccagacacaugcuaacaggaucuacaggaugaucaaacuuggucuggguauugaugaagaugacccuacugcugaugauaccagugcugcuguaacugaagaaaugccaccccuugaaggagaugacgacacaucacgcauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3874 - RNA, 686 nt, Artificial Sequence
  mRNA product Design3 comprising derived and/or modified sequence from Homo sapiens__NG_005218__HsHSP90AA3P (wt)
gggagagucccgcagucggcguccagcggcucugcuuguucgugugugugucguugcaggccuuauucaagcuuaccauggauuccaguaaauuagacucugggaaagggcugcauauuaaccuuguaccaaacaaacaaaaucaaacccucacuauuguggacacuagaauuggaaugaccaagacugacuugaucaauaaccucgguacugucaccaagucugggaccaaagcauucauggaagcuuugcaggcugaugcagauaucucuaugauuggccauuucgggguugguuuuuauucugcuuauuugguugccaagaaaguaacugugaucagcaaacauaacaaugaugagcaguacaccugggaguccucagcagggggaucauucacagugaggacagacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3875 - RNA, 2522 nt, Artificial Sequence
  mRNA product Design3 comprising derived and/or modified sequence from Homo sapiens__NP_031381.2__HsHSP90AB1 (wt)
gggagagucccgcagucggcguccagcggcucugcuuguucgugugugugucguugcaggccuuauucaagcuuaccaugccugaggaagugcaccauggagaggaggagguggagacuuuugccuuucaggcagaaauugcccaacucaugucccucaucaucaauaccuucuauuccaacaaggagauuuuccuucgggaguugaucucuaaugcuucugaugccuuggacaagauucgcuaugagagccugacagacccuucgaaguuggacagugguaaagagcugaaaauugacaucauccccaacccucaggaacguacccugacuuugguagacacaggcauuggcaugaccaaagcugaucucauaaauaauuugggaaccauugccaagucugguacuaaagcauucauggaggcucuucaggcuggugcagacaucuccaugauugggcaguuugguguuggcuuuuauucugccuacuugguggcagagaaagugguugugaucacaaagcacaacgaugaugaacaguaugcuugggagucuucugcuggagguuccuucacugugcgugcugaccauggugagcccauuggcagggguaccaaagugauccuccaucuuaaagaagaucagacagaguaccuagaagagaggcgggucaaagaaguagugaagaagcauucucaguucauaggcuaucccaucacccuuuauuuggagaaggaacgagagaaggaaauuagugaugaugaggcagaggaagagaaaggugagaaagaagaggaagauaaagaugaugaagaaaaacccaagaucgaagauguggguucagaugaggaggaugacagcgguaaggauaagaagaagaaaacuaagaagaucaaagagaaauacauugaucaggaagaacuaaacaagaccaagccuauuuggaccagaaacccugaugacaucacccaagaggaguauggagaauucuacaagagccucacuaaugacugggaagaccacuuggcagucaagcacuuuucuguagaaggucaguuggaauucagggcauugcuauuuauuccucgucgggcucccuuugaccuuuuugagaacaagaagaaaaagaacaacaucaaacucuauguccgccguguguucaucauggacagcugugaugaguugauaccagaguaucucaauuuuauccguggugugguugacucugaggaucugccccugaacaucucccgagaaaugcuccagcagagcaaaaucuugaaagucauucgcaaaaacauuguuaagaagugccuugagcucuucucugagcuggcagaagacaaggagaauuacaagaaauucuaugaggcauucucuaaaaaucucaagcuuggaauccacgaagacuccacuaaccgccgccgccugucugagcugcugcgcuaucauaccucccagucuggagaugagaugacaucucugucagaguauguuucucgcaugaaggagacacagaaguccaucuauuacaucacuggugagagcaaagagcagguggccaacucagcuuuuguggagcgagugcggaaacggggcuucgaggugguauauaugaccgagcccauugacgaguacugugugcagcagcucaaggaauuugaugggaagagccuggucucaguuaccaaggagggucuggagcugccugaggaugaggaggagaagaagaagauggaagagagcaaggcaaaguuugagaaccucugcaagcucaugaaagaaaucuuagauaagaagguugagaaggugacaaucuccaauagacuugugucuucaccuugcugcauugugaccagcaccuacggcuggacagccaauauggagcggaucaugaaagcccaggcacuucgggacaacuccaccaugggcuauaugauggccaaaaagcaccuggagaucaacccugaccaccccauuguggagacgcugcggcagaaggcugaggccgacaagaaugauaaggcaguuaaggaccugguggugcugcuguuugaaaccgcccugcuaucuucuggcuuuucccuugaggauccccagacccacuccaaccgcaucuaucgcaugaucaagcuaggucuagguauugaugaagaugaaguggcagcagaggaacccaaugcugcaguuccugaugagauccccccucucgagggcgaugaggaugcgucucgcauggaagaagucgauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3876 - RNA, 2759 nt, Artificial Sequence
  mRNA product Design3 comprising derived and/or modified sequence from Homo sapiens__NP_003290.1__HsHSP90B1 (wt)
gggagagucccgcagucggcguccagcggcucugcuuguucgugugugugucguugcaggccuuauucaagcuuaccaugagggcccugugggugcugggccucugcugcguccugcugaccuucgggucggucagagcugacgaugaaguugauguggaugguacaguagaagaggaucuggguaaaaguagagaaggaucaaggacggaugaugaaguaguacagagagaggaagaagcuauucaguuggauggauuaaaugcaucacaaauaagagaacuuagagagaagucggaaaaguuugccuuccaagccgaaguuaacagaaugaugaaacuuaucaucaauucauuguauaaaaauaaagagauuuuccugagagaacugauuucaaaugcuucugaugcuuuagauaagauaaggcuaauaucacugacugaugaaaaugcucuuucuggaaaugaggaacuaacagucaaaauuaagugugauaaggagaagaaccugcugcaugucacagacaccgguguaggaaugaccagagaagaguugguuaaaaaccuugguaccauagccaaaucugggacaagcgaguuuuuaaacaaaaugacugaagcacaggaagauggccagucaacuucugaauugauuggccaguuuggugucgguuucuauuccgccuuccuuguagcagauaagguuauugucacuucaaaacacaacaacgauacccagcacaucugggagucugacuccaaugaauuuucuguaauugcugacccaagaggaaacacucuaggacggggaacgacaauuacccuugucuuaaaagaagaagcaucugauuaccuugaauuggauacaauuaaaaaucucgucaaaaaauauucacaguucauaaacuuuccuauuuauguauggagcagcaagacugaaacuguugaggagcccauggaggaagaagaagcagccaaagaagagaaagaagaaucugaugaugaagcugcaguagaggaagaagaagaagaaaagaaaccaaagacuaaaaaaguugaaaaaacugucugggacugggaacuuaugaaugauaucaaaccaauauggcagagaccaucaaaagaaguagaagaagaugaauacaaagcuuucuacaaaucauuuucaaaggaaagugaugaccccauggcuuauauucacuuuacugcugaaggggaaguuaccuucaaaucaauuuuauuuguacccacaucugcuccacguggucuguuugacgaauauggaucuaaaaagagcgauuacauuaagcucuaugugcgccguguauucaucacagacgacuuccaugauaugaugccuaaauaccucaauuuugucaagggugugguggacucagaugaucuccccuugaauguuucccgcgagacucuucagcaacauaaacugcuuaaggugauuaggaagaagcuuguucguaaaacgcuggacaugaucaagaagauugcugaugauaaauacaaugauacuuuuuggaaagaauuugguaccaacaucaagcuuggugugauugaagaccacucgaaucgaacacgucuugcuaaacuucuuagguuccagucuucucaucauccaacugacauuacuagccuagaccaguauguggaaagaaugaaggaaaaacaagacaaaaucuacuucauggcuggguccagcagaaaagaggcugaaucuucuccauuuguugagcgacuucugaaaaagggcuaugaaguuauuuaccucacagaaccuguggaugaauacuguauucaggcccuucccgaauuugaugggaagagguuccagaauguugccaaggaaggagugaaguucgaugaaagugagaaaacuaaggagagucgugaagcaguugagaaagaauuugagccucugcugaauuggaugaaagauaaagcccuuaaggacaagauugaaaaggcuguggugucucagcgccugacagaaucuccgugugcuuugguggccagccaguacggauggucuggcaacauggagagaaucaugaaagcacaagcguaccaaacgggcaaggacaucucuacaaauuacuaugcgagucagaagaaaacauuugaaauuaaucccagacacccgcugaucagagacaugcuucgacgaauuaaggaagaugaagaugauaaaacaguuuuggaucuugcugugguuuuguuugaaacagcaacgcuucggucaggguaucuuuuaccagacacuaaagcauauggagauagaauagaaagaaugcuucgccucaguuugaacauugacccugaugcaaagguggaagaagagcccgaagaagaaccugaagagacagcagaagacacaacagaagacacagagcaagacgaagaugaagaaauggaugugggaacagaugaagaagaagaaacagcaaaggaaucuacagcugaaaaagaugaauuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3877 - RNA, 2462 nt, Artificial Sequence
  mRNA product Design3 comprising derived and/or modified sequence from Homo sapiens__NP_057376.2__HsTRAP1 (wt)
gggagagucccgcagucggcguccagcggcucugcuuguucgugugugugucguugcaggccuuauucaagcuuaccauggcgcgcgagcugcgggcgcugcugcuguggggccgccgccugcggccuuugcugcgggcgccggcgcuggcggccgugccgggaggaaaaccaauucuguguccucggaggaccacagcccaguugggccccaggcgaaacccagccuggagcuugcaggcaggacgacuguucagcacgcagaccgccgaggacaaggaggaaccccugcacucgauuaucagcagcacagagagcgugcaggguuccacuuccaaacaugaguuccaggccgagacaaagaagcuuuuggacauuguugcccggucccuguacucagaaaaagagguguuuauacgggagcugaucuccaaugccagcgaugccuuggaaaaacugcgucacaaacuggugucugacggccaagcacugccagaaauggagauucacuugcagaccaaugccgagaaaggcaccaucaccauccaggauacugguaucgggaugacacaggaagagcugguguccaaccuggggacgauugccagaucggggucaaaggccuuccuggaugcucugcagaaccaggcugaggccagcagcaagaucaucggccaguuuggaguggguuucuacucagcuuucaugguggcugacagaguggaggucuauucccgcucggcagccccggggagccuggguuaccaguggcuuucagaugguucuggaguguuugaaaucgccgaagcuucgggaguuagaaccgggacaaaaaucaucauccaccugaaauccgacugcaaggaguuuuccagcgaggcccgggugcgagaugugguaacgaaguacagcaacuucgucagcuuccccuuguacuugaauggaaggcggaugaacaccuugcaggccaucuggaugauggaccccaaggauguccgugaguggcaacaugaggaguucuaccgcuacgucgcgcaggcucacgacaagccccgcuacacccugcacuauaagacggacgcaccgcucaacauccgcagcaucuucuacgugcccgacaugaaaccguccauguuugaugugagccgggagcugggcuccagcguugcacuguacagccgcaaaguccucauccagaccaaggccacggacauccugcccaaguggcugcgcuucauccgaggugugguggacagugaggacauuccccugaaccucagccgggagcugcugcaggagagcgcacucaucaggaaacuccgggacguuuuacagcagaggcugaucaaauucuucauugaccagaguaaaaaagaugcugagaaguaugcaaaguuuuuugaagauuacggccuguucaugcgggagggcauugugaccgccaccgagcaggaggucaaggaggacauagcaaagcugcugcgcuacgaguccucggcgcugcccuccgggcagcuaaccagccucucagaauacgccagccgcaugcgggccggcacccgcaacaucuacuaccugugcgcccccaaccgucaccuggcagagcacucacccuacuaugaggccaugaagaagaaagacacagagguucucuucugcuuugagcaguuugaugagcucacccugcugcaccuucgugaguuugacaagaagaagcugaucucuguggagacggacauagucguggaucacuacaaggaggagaaguuugaggacagguccccagccgccgagugccuaucagagaaggagacggaggagcucauggccuggaugagaaaugugcuggggucgcgugucaccaacgugaaggugacccuccgacuggacacccacccugccauggucaccgugcuggagaugggggcugcccgccacuuccugcgcaugcagcagcuggccaagacccaggaggagcgcgcacagcuccugcagcccacgcuggagaucaaccccaggcacgcgcucaucaagaagcugaaucagcugcgcgcaagcgagccuggccuggcucagcugcugguggaucagauauacgagaacgccaugauugcugcuggacuuguugacgacccuagggccauggugggccgcuugaaugagcugcuugucaaggcccuggagcgacacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3878 - RNA, 809 nt, Artificial Sequence
  mRNA product Design3 comprising derived and/or modified sequence from Homo sapiens__NP_000609.1__HsIGF1 (wt)
gggagagucccgcagucggcguccagcggcucugcuuguucgugugugugucguugcaggccuuauucaagcuuaccaugggaaaaaucagcagucuuccaacccaauuauuuaagugcugcuuuugugauuucuugaaggugaagaugcacaccauguccuccucgcaucucuucuaccuggcgcugugccugcucaccuucaccagcucugccacggcuggaccggagacgcucugcggggcugagcugguggaugcucuucaguucguguguggagacaggggcuuuuauuucaacaagcccacaggguauggcuccagcagucggagggcgccucagacaggcaucguggaugagugcugcuuccggagcugugaucuaaggaggcuggagauguauugcgcaccccucaagccugccaagucagcucgcucuguccgugcccagcgccacaccgacaugcccaagacccagaaggaaguacauuugaagaacgcaaguagagggagugcaggaaacaagaacuacaggauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3879 - RNA, 890 nt, Artificial Sequence
  mRNA product Design3 comprising derived and/or modified sequence from Homo sapiens__NP_000603.1__HsIGF2 (wt)
gggagagucccgcagucggcguccagcggcucugcuuguucgugugugugucguugcaggccuuauucaagcuuaccaugggaaucccaauggggaagucgaugcuggugcuucucaccuucuuggccuucgccucgugcugcauugcugcuuaccgccccagugagacccugugcggcggggagcugguggacacccuccaguucgucuguggggaccgcggcuucuacuucagcaggcccgcaagccgugugagccgucgcagccguggcaucguugaggagugcuguuuccgcagcugugaccuggcccuccuggagacguacugugcuacccccgccaaguccgagagggacgugucgaccccuccgaccgugcuuccggacaacuuccccagauaccccgugggcaaguucuuccaauaugacaccuggaagcaguccacccagcgccugcgcaggggccugccugcccuccugcgugcccgccggggucacgugcucgccaaggagcucgaggcguucagggaggccaaacgucaccguccccugauugcucuacccacccaagaccccgcccacgggggcgcccccccagagauggccagcaaucggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3880 - RNA, 986 nt, Artificial Sequence
  mRNA product Design3 comprising derived and/or modified sequence from Homo sapiens__NP_000591.1__HsIL6 (wt)
gggagagucccgcagucggcguccagcggcucugcuuguucgugugugugucguugcaggccuuauucaagcuuaccaugaacuccuucuccacaagcgccuucgguccaguugccuucucccuggggcugcuccugguguugccugcugccuucccugccccaguacccccaggagaagauuccaaagauguagccgccccacacagacagccacucaccucuucagaacgaauugacaaacaaauucgguacauccucgacggcaucucagcccugagaaaggagacauguaacaagaguaacaugugugaaagcagcaaagaggcacuggcagaaaacaaccugaaccuuccaaagauggcugaaaaagauggaugcuuccaaucuggauucaaugaggagacuugccuggugaaaaucaucacuggucuuuuggaguuugagguauaccuagaguaccuccagaacagauuugagaguagugaggaacaagccagagcugugcagaugaguacaaaaguccugauccaguuccugcagaaaaaggcaaagaaucuagaugcaauaaccaccccugacccaaccacaaaugccagccugcugacgaagcugcaggcacagaaccaguggcugcaggacaugacaacucaucucauucugcgcagcuuuaaggaguuccugcaguccagccugagggcucuucggcaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3881 - RNA, 1628 nt, Artificial Sequence
  mRNA product Design3 comprising derived and/or modified sequence from Homo sapiens__NP_002183.1__HsINHBA (wt)
gggagagucccgcagucggcguccagcggcucugcuuguucgugugugugucguugcaggccuuauucaagcuuaccaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3882 - RNA, 1571 nt, Artificial Sequence
  mRNA product Design3 comprising derived and/or modified sequence from Homo sapiens__NP_002184.2__HsINHBB (wt)
gggagagucccgcagucggcguccagcggcucugcuuguucgugugugugucguugcaggccuuauucaagcuuaccauggacgggcugcccggucgggcgcugggggccgccugccuucugcugcuggcggccggcuggcuggggccugaggccuggggcucacccacgcccccgccgacgccugccgcgccgccgccacccccgccacccggauccccggguggcucgcaggacaccuguacgucgugcggcggcuuccggcggccagaggagcucggccgaguggacggcgacuuccuggaggcggugaagcggcacaucuugagccgccugcagaugcggggccggcccaacaucacgcacgccgugccuaaggccgccauggucacggcccugcgcaagcugcacgcgggcaaggugcgcgaggacggccgcguggagaucccgcaccucgacggccacgccagcccgggcgccgacggccaggagcgcguuuccgaaaucaucagcuucgccgagacagauggccucgccuccucccggguccgccuauacuucuucaucuccaacgaaggcaaccagaaccuguuugugguccaggccagccuguggcuuuaccugaaacuccugcccuacguccuggagaagggcagccggcggaaggugcgggucaaaguguacuuccaggagcagggccacggugacagguggaacaugguggagaagaggguggaccucaagcgcagcggcuggcauaccuucccacucacggaggccauccaggccuuguuugagcggggcgagcggcgacucaaccuagacgugcagugugacagcugccaggagcuggccguggugccgguguucguggacccaggcgaagagucgcaccggcccuuugugguggugcaggcucggcugggcgacagcaggcaccgcauucgcaagcgaggccuggagugcgauggccggaccaaccucuguugcaggcaacaguucuucauugacuuccgccucaucggcuggaacgacuggaucauagcacccaccggcuacuacgggaacuacugugagggcagcugcccagccuaccuggcagggguccccggcucugccuccuccuuccacacggcuguggugaaccaguaccgcaugcggggucugaaccccggcacggugaacuccugcugcauucccaccaagcugagcaccauguccaugcuguacuucgaugaugaguacaacaucgucaagcgggacgugcccaacaugauuguggaggagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3883 - RNA, 3806 nt, Artificial Sequence
  mRNA product Design3 comprising derived and/or modified sequence from Homo sapiens__NP_000623.2__HsITGAM (wt)
gggagagucccgcagucggcguccagcggcucugcuuguucgugugugugucguugcaggccuuauucaagcuuaccauggcucucagaguccuucuguuaacagccuugaccuuaugucauggguucaacuuggacacugaaaacgcaaugaccuuccaagagaacgcaaggggcuucgggcagagcgugguccagcuucagggauccaggguggugguuggagccccccaggagauaguggcugccaaccaaaggggcagccucuaccagugcgacuacagcacaggcucaugcgagcccauccgccugcagguccccguggaggccgugaacaugucccugggccugucccuggcagccaccaccagccccccucagcugcuggccuguggucccaccgugcaccagacuugcagugagaacacguaugugaaagggcucugcuuccuguuuggauccaaccuacggcagcagccccagaaguucccagaggcccuccgaggguguccucaagaggauagugacauugccuucuugauugauggcucugguagcaucaucccacaugacuuucggcggaugaaggaguuugucucaacugugauggagcaauuaaaaaaguccaaaaccuuguucucuuugaugcaguacucugaagaauuccggauucacuuuaccuucaaagaguuccagaacaacccuaacccaagaucacuggugaagccaauaacgcagcugcuugggcggacacacacggccacgggcauccgcaaagugguacgagagcuguuuaacaucaccaacggagcccgaaagaaugccuuuaagauccuaguugucaucacggauggagaaaaguuuggcgaucccuugggauaugaggaugucaucccugaggcagacagagagggagucauucgcuacgucauuggggugggagaugccuuccgcagugagaaaucccgccaagagcuuaauaccaucgcauccaagccgccucgugaucacguguuccaggugaauaacuuugaggcucugaagaccauucagaaccagcuucgggagaagaucuuugcgaucgaggguacucagacaggaaguagcagcuccuuugagcaugagaugucucaggaaggcuucagcgcugccaucaccucuaauggccccuugcugagcacuguggggagcuaugacugggcugguggagucuuucuauauacaucaaaggagaaaagcaccuucaucaacaugaccagaguggauucagacaugaaugaugcuuacuuggguuaugcugccgccaucaucuuacggaaccgggugcaaagccugguucugggggcaccucgauaucagcacaucggccugguagcgauguucaggcagaacacuggcaugugggaguccaacgcuaaugucaagggcacccagaucggcgccuacuucggggccucccucugcuccguggacguggacagcaacggcagcaccgaccugguccucaucggggccccccauuacuacgagcagacccgagggggccagguguccgugugccccuugcccagggggagggcucgguggcagugugaugcuguucucuacggggagcagggccaacccuggggccgcuuuggggcagcccuaacagugcugggggacguaaauggggacaagcugacggacguggccauuggggccccaggagaggaggacaaccggggugcuguuuaccuguuucacggaaccucaggaucuggcaucagccccucccauagccagcggauagcaggcuccaagcucucucccaggcuccaguauuuuggucagucacugagugggggccaggaccucacaauggauggacugguagaccugacuguaggagcccaggggcacgugcugcugcucaggucccagccaguacugagagucaaggcaaucauggaguucaaucccagggaaguggcaaggaauguauuugaguguaaugaucagguggugaaaggcaaggaagccggagaggucagagucugccuccauguccagaagagcacacgggaucggcuaagagaaggacagauccagaguguugugacuuaugaccuggcucuggacuccggccgcccacauucccgcgccgucuucaaugagacaaagaacagcacacgcagacagacacaggucuuggggcugacccagacuugugagacccugaaacuacaguugccgaauugcaucgaggacccagugagccccauugugcugcgccugaacuucucucuggugggaacgccauugucugcuuucgggaaccuccggccagugcuggcggaggaugcucagagacucuucacagccuuguuucccuuugagaagaauuguggcaaugacaacaucugccaggaugaccucagcaucaccuucaguuucaugagccuggacugccucguggugggugggccccgggaguucaacgugacagugacugugagaaaugauggugaggacuccuacaggacacaggucaccuucuucuucccgcuugaccuguccuaccggaagguguccacgcuccagaaccagcgcucacagcgauccuggcgccuggccugugagucugccuccuccaccgaagugucuggggccuugaagagcaccagcugcagcauaaaccaccccaucuucccggaaaacucagaggucaccuuuaauaucacguuugauguagacucuaaggcuucccuuggaaacaaacugcuccucaaggccaaugugaccagugagaacaacaugcccagaaccaacaaaaccgaauuccaacuggagcugccggugaaauaugcugucuacaugguggucaccagccauggggucuccacuaaauaucucaacuucacggccucagagaauaccagucgggucaugcagcaucaauaucaggucagcaaccuggggcagaggagccuccccaucagccugguguucuuggugcccguccggcugaaccagacugucauaugggaccgcccccaggucaccuucuccgagaaccucucgaguacgugccacaccaaggagcgcuugcccucucacuccgacuuucuggcugagcuucggaaggcccccguggugaacugcuccaucgcugucugccagagaauccagugugacaucccguucuuuggcauccaggaagaauucaaugcuacccucaaaggcaaccucucguuugacugguacaucaagaccucgcauaaccaccuccugaucgugagcacagcugagaucuuguuuaacgauuccguguucacccugcugccgggacagggggcguuugugaggucccagacggagaccaaaguggagccguucgagguccccaacccccugccgcucaucgugggcagcucugucgggggacugcugcuccuggcccucaucaccgccgcgcuguacaagcucggcuucuucaagcggcaauacaaggacaugaugagugaagggggucccccgggggccgaaccccaguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3884 - RNA, 1751 nt, Artificial Sequence
  mRNA product Design3 comprising derived and/or modified sequence from Homo sapiens__NP_002415.1__HsMMP8 (wt)
gggagagucccgcagucggcguccagcggcucugcuuguucgugugugugucguugcaggccuuauucaagcuuaccauguucucccugaagacgcuuccauuucugcucuuacuccaugugcagauuuccaaggccuuuccuguaucuucuaaagagaaaaauacaaaaacuguucaggacuaccuggaaaaguucuaccaauuaccaagcaaccaguaucagucuacaaggaagaauggcacuaaugugaucguugaaaagcuuaaagaaaugcagcgauuuuuuggguugaaugugacggggaagccaaaugaggaaacucuggacaugaugaaaaagccucgcuguggagugccugacaguggugguuuuauguuaaccccaggaaaccccaagugggaacgcacuaacuugaccuacaggauucgaaacuauaccccacagcugucagaggcugagguagaaagagcuaucaaggaugccuuugaacucuggaguguugcaucaccucucaucuucaccaggaucucacagggagaggcagauaucaacauugcuuuuuaccaaagagaucacggugacaauucuccauuugauggacccaauggaauccuugcucaugccuuucagccaggccaagguauuggaggagaugcucauuuugaugccgaagaaacauggaccaacaccuccgcaaauuacaacuuguuucuuguugcugcucaugaauuuggccauucuuuggggcucgcucacuccucugacccuggugccuugauguaucccaacuaugcuuucagggaaaccagcaacuacucacucccucaagaugacaucgauggcauucaggccaucuauggacuuucaagcaacccuauccaaccuacuggaccaagcacacccaaacccugugaccccaguuugacauuugaugcuaucaccacacuccguggagaaauacuuuucuuuaaagacagguacuucuggagaaggcauccucagcuacaaagagucgaaaugaauuuuauuucucuauucuggccaucccuuccaacugguauacaggcugcuuaugaagauuuugacagagaccucauuuuccuauuuaaaggcaaccaauacugggcucugaguggcuaugauauucugcaagguuaucccaaggauauaucaaacuauggcuuccccagcagcguccaagcaauugacgcagcuguuuucuacagaaguaaaacauacuucuuuguaaaugaccaauucuggagauaugauaaccaaagacaauucauggagccagguuaucccaaaagcauaucaggugccuuuccaggaauagagaguaaaguugaugcaguuuuccagcaagaacauuucuuccaugucuucaguggaccaagauauuacgcauuugaucuuauugcucagagaguuaccagaguugcaagaggcaauaaauggcuuaacuguagauauggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3885 - RNA, 2471 nt, Artificial Sequence
  mRNA product Design3 comprising derived and/or modified sequence from Homo sapiens__NP_004985.2__HsMMP9 (wt)
gggagagucccgcagucggcguccagcggcucugcuuguucgugugugugucguugcaggccuuauucaagcuuaccaugagccucuggcagccccugguccuggugcuccuggugcugggcugcugcuuugcugcccccagacagcgccaguccacccuugugcucuucccuggagaccugagaaccaaucucaccgacaggcagcuggcagaggaauaccuguaccgcuaugguuacacucggguggcagagaugcguggagagucgaaaucucuggggccugcgcugcugcuucuccagaagcaacugucccugcccgagaccggugagcuggauagcgccacgcugaaggccaugcgaaccccacggugcggggucccagaccugggcagauuccaaaccuuugagggcgaccucaaguggcaccaccacaacaucaccuauuggauccaaaacuacucggaagacuugccgcgggcggugauugacgacgccuuugcccgcgccuucgcacuguggagcgcggugacgccgcucaccuucacucgcguguacagccgggacgcagacaucgucauccaguuuggugucgcggagcacggagacggguaucccuucgacgggaaggacgggcuccuggcacacgccuuuccuccuggccccggcauucagggagacgcccauuucgacgaugacgaguuguggucccugggcaagggcgucgugguuccaacucgguuuggaaacgcagauggcgcggccugccacuuccccuucaucuucgagggccgcuccuacucugccugcaccaccgacggucgcuccgacggcuugcccuggugcaguaccacggccaacuacgacaccgacgaccgguuuggcuucugccccagcgagagacucuacacccaggacggcaaugcugaugggaaacccugccaguuuccauucaucuuccaaggccaauccuacuccgccugcaccacggacggucgcuccgacggcuaccgcuggugcgccaccaccgccaacuacgaccgggacaagcucuucggcuucugcccgacccgagcugacucgacggugauggggggcaacucggcgggggagcugugcgucuuccccuucacuuuccuggguaaggaguacucgaccuguaccagcgagggccgcggagaugggcgccucuggugcgcuaccaccucgaacuuugacagcgacaagaaguggggcuucugcccggaccaaggauacaguuuguuccucguggcggcgcaugaguucggccacgcgcugggcuuagaucauuccucagugccggaggcgcucauguacccuauguaccgcuucacugaggggccccccuugcauaaggacgacgugaauggcauccggcaccucuaugguccucgcccugaaccugagccacggccuccaaccaccaccacaccgcagcccacggcucccccgacggucugccccaccggaccccccacuguccaccccucagagcgccccacagcuggccccacagguccccccucagcuggccccacagguccccccacugcuggcccuucuacggccacuacugugccuuugaguccgguggacgaugccugcaacgugaacaucuucgacgccaucgcggagauugggaaccagcuguauuuguucaaggaugggaaguacuggcgauucucugagggcagggggagccggccgcagggccccuuccuuaucgccgacaaguggcccgcgcugccccgcaagcuggacucggucuuugaggagcggcucuccaagaagcuuuucuucuucucugggcgccagguguggguguacacaggcgcgucggugcugggcccgaggcgucuggacaagcugggccugggagccgacguggcccaggugaccggggcccuccggaguggcagggggaagaugcugcuguucagcgggcggcgccucuggagguucgacgugaaggcgcagaugguggauccccggagcgccagcgagguggaccggauguuccccggggugccuuuggacacgcacgacgucuuccaguaccgagagaaagccuauuucugccaggaccgcuucuacuggcgcgugaguucccggagugaguugaaccagguggaccaagugggcuacgugaccuaugacauccugcagugcccugaggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3886 - RNA, 1763 nt, Artificial Sequence
  mRNA product Design3 comprising derived and/or modified sequence from Homo sapiens__NP_002418.1__HsMMP13 (wt)
gggagagucccgcagucggcguccagcggcucugcuuguucgugugugugucguugcaggccuuauucaagcuuaccaugcauccagggguccuggcugccuuccucuucuugagcuggacucauugucgggcccugccccuucccagugguggugaugaagaugauuugucugaggaagaccuccaguuugcagagcgcuaccugagaucauacuaccauccuacaaaucucgcgggaauccugaaggagaaugcagcaagcuccaugacugagaggcuccgagaaaugcagucuuucuucggcuuagaggugacuggcaaacuugacgauaacaccuuagaugucaugaaaaagccaagaugcgggguuccugaugugggugaauacaauguuuucccucgaacucuuaaaugguccaaaaugaauuuaaccuacagaauugugaauuacaccccugauaugacucauucugaagucgaaaaggcauucaaaaaagccuucaaaguuugguccgauguaacuccucugaauuuuaccagacuucacgauggcauugcugacaucaugaucucuuuuggaauuaaggagcauggcgacuucuacccauuugaugggcccucuggccugcuggcucaugcuuuuccuccugggccaaauuauggaggagaugcccauuuugaugaugaugaaaccuggacaaguaguuccaaaggcuacaacuuguuucuuguugcugcgcaugaguucggccacuccuuaggucuugaccacuccaaggacccuggagcacucauguuuccuaucuacaccuacaccggcaaaagccacuuuaugcuuccugaugacgauguacaagggauccagucucucuaugguccaggagaugaagaccccaacccuaaacauccaaaaacgccagacaaaugugacccuuccuuaucccuugaugccauuaccagucuccgaggagaaacaaugaucuuuaaagacagauucuucuggcgccugcauccucagcagguugaugcggagcuguuuuuaacgaaaucauuuuggccagaacuucccaaccguauugaugcugcauaugagcacccuucucaugaccucaucuucaucuucagagguagaaaauuuugggcucuuaaugguuaugacauucuggaagguuaucccaaaaaaauaucugaacugggucuuccaaaagaaguuaagaagauaagugcagcuguucacuuugaggauacaggcaagacucuccuguucucaggaaaccaggucuggagauaugaugauacuaaccauauuauggauaaagacuauccgagacuaauagaagaagacuucccaggaauuggugauaaaguagaugcugucuaugagaaaaaugguuauaucuauuuuuucaacggacccauacaguuugaauacagcaucuggaguaaccguauuguucgcgucaugccagcaaauuccauuuugugguguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3887 - RNA, 1415 nt, Artificial Sequence
  mRNA product Design3 comprising derived and/or modified sequence from Homo sapiens__NP_001286.1__HsCCR1 (wt)
gggagagucccgcagucggcguccagcggcucugcuuguucgugugugugucguugcaggccuuauucaagcuuaccauggaaacuccaaacaccacagaggacuaugacacgaccacagaguuugacuauggggaugcaacuccgugccagaaggugaacgagagggccuuuggggcccaacugcugcccccucuguacuccuugguauuugucauuggccugguuggaaacauccuggugguccugguccuugugcaauacaagaggcuaaaaaacaugaccagcaucuaccuccugaaccuggccauuucugaccugcucuuccuguucacgcuucccuucuggaucgacuacaaguugaaggaugacuggguuuuuggugaugccauguguaagauccucucuggguuuuauuacacaggcuuguacagcgagaucuuuuucaucauccugcugacgauugacagguaccuggccaucguccacgccguguuugccuugcgggcacggaccgucacuuuuggugucaucaccagcaucaucauuugggcccuggccaucuuggcuuccaugccaggcuuauacuuuuccaagacccaaugggaauucacucaccacaccugcagccuucacuuuccucacgaaagccuacgagaguggaagcuguuucaggcucugaaacugaaccucuuugggcugguauugccuuuguuggucaugaucaucugcuacacagggauuauaaagauucugcuaagacgaccaaaugagaagaaauccaaagcuguccguuugauuuuugucaucaugaucaucuuuuuucucuuuuggacccccuacaauuugacuauacuuauuucuguuuuccaagacuuccuguucacccaugagugugagcagagcagacauuuggaccuggcugugcaagugacggaggugaucgccuacacgcacugcugugucaacccagugaucuacgccuucguuggugagagguuccggaaguaccugcggcaguuguuccacaggcguguggcugugcaccugguuaaauggcuccccuuccucuccguggacaggcuggagagggucagcuccacaucucccuccacaggggagcaugaacucucugcuggguucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3888 - RNA, 983 nt, Artificial Sequence
  mRNA product Design3 comprising derived and/or modified sequence from Homo sapiens__NP_002598.4__HsPDGFA (wt)
gggagagucccgcagucggcguccagcggcucugcuuguucgugugugugucguugcaggccuuauucaagcuuaccaugaggaccuuggcuugccugcugcuccucggcugcggauaccucgcccauguucuggccgaggaagccgagaucccccgcgaggugaucgagaggcuggcccgcagucagauccacagcauccgggaccuccagcgacuccuggagauagacuccguagggagugaggauucuuuggacaccagccugagagcucacgggguccaugccacuaagcaugugcccgagaagcggccccugcccauucggaggaagagaagcaucgaggaagcuguccccgcugucugcaagaccaggacggucauuuacgagauuccucggagucaggucgaccccacguccgccaacuuccugaucuggcccccgugcguggaggugaaacgcugcaccggcugcugcaacacgagcagugucaagugccagcccucccgcguccaccaccgcagcgucaagguggccaagguggaauacgucaggaagaagccaaaauuaaaagaaguccaggugagguuagaggagcauuuggagugcgccugcgcgaccacaagccugaauccggauuaucgggaagaggacacgggaaggccuagggagucagguaaaaaacggaaaagaaaaagguuaaaacccaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3889 - RNA, 1073 nt, Artificial Sequence
  mRNA product Design3 comprising derived and/or modified sequence from Homo sapiens__NP_002599.1__HsPDGFB (wt)
gggagagucccgcagucggcguccagcggcucugcuuguucgugugugugucguugcaggccuuauucaagcuuaccaugaaucgcugcugggcgcucuuccugucucucugcugcuaccugcgucuggucagcgccgagggggaccccauucccgaggagcuuuaugagaugcugagugaccacucgauccgcuccuuugaugaucuccaacgccugcugcacggagaccccggagaggaagauggggccgaguuggaccugaacaugacccgcucccacucuggaggcgagcuggagagcuuggcucguggaagaaggagccuggguucccugaccauugcugagccggccaugaucgccgagugcaagacgcgcaccgagguguucgagaucucccggcgccucauagaccgcaccaacgccaacuuccugguguggccgcccuguguggaggugcagcgcugcuccggcugcugcaacaaccgcaacgugcagugccgccccacccaggugcagcugcgaccuguccaggugagaaagaucgagauugugcggaagaagccaaucuuuaagaaggccacggugacgcuggaagaccaccuggcaugcaagugugagacaguggcagcugcacggccugugacccgaagcccgggggguucccaggagcagcgagccaaaacgccccaaacucgggugaccauucggacggugcgaguccgccggccccccaagggcaagcaccggaaauucaagcacacgcaugacaagacggcacugaaggagacccuuggagccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3890 - RNA, 1385 nt, Artificial Sequence
  mRNA product Design3 comprising derived and/or modified sequence from Homo sapiens__NP_057289.1__HsPDGFC (wt)
gggagagucccgcagucggcguccagcggcucugcuuguucgugugugugucguugcaggccuuauucaagcuuaccaugagccucuucgggcuucuccugcugacaucugcccuggccggccagagacaggggacucaggcggaauccaaccugaguaguaaauuccaguuuuccagcaacaaggaacagaacggaguacaagauccucagcaugagagaauuauuacugugucuacuaauggaaguauucacagcccaagguuuccucauacuuauccaagaaauacggucuugguauggagauuaguagcaguagaggaaaauguauggauacaacuuacguuugaugaaagauuugggcuugaagacccagaagaugacauaugcaaguaugauuuuguagaaguugaggaacccagugauggaacuauauuagggcgcuggugugguucugguacuguaccaggaaaacagauuucuaaaggaaaucaaauuaggauaagauuuguaucugaugaauauuuuccuucugaaccaggguucugcauccacuacaacauugucaugccacaauucacagaagcugugaguccuucagugcuacccccuucagcuuugccacuggaccugcuuaauaaugcuauaacugccuuuaguaccuuggaagaccuuauucgauaucuugaaccagagagauggcaguuggacuuagaagaucuauauaggccaacuuggcaacuucuuggcaaggcuuuuguuuuuggaagaaaauccagagugguggaucugaaccuucuaacagaggagguaagauuauacagcugcacaccucguaacuucucaguguccauaagggaagaacuaaagagaaccgauaccauuuucuggccagguugucuccugguuaaacgcuguggugggaacugugccuguugucuccacaauugcaaugaaugucaaugugucccaagcaaaguuacuaaaaaauaccacgagguccuucaguugagaccaaagaccggugucaggggauugcacaaaucacucaccgacguggcccuggagcaccaugaggagugugacugugugugcagagggagcacaggaggauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3891 - RNA, 1442 nt, Artificial Sequence
  mRNA product Design3 comprising derived and/or modified sequence from Homo sapiens__NP_149126.1__HsPDGFD (wt)
gggagagucccgcagucggcguccagcggcucugcuuguucgugugugugucguugcaggccuuauucaagcuuaccaugcaccggcucaucuuugucuacacucuaaucugcgcaaacuuuugcagcugucgggacacuucugcaaccccgcagagcgcauccaucaaagcuuugcgcaacgccaaccucaggcgagaugacuuguaccgaagagaugagaccauccaggugaaaggaaacggcuacgugcagaguccuagauucccgaacagcuaccccaggaaccugcuccugacauggcggcuucacucucaggagaauacacggauacagcuaguguuugacaaucaguuuggauuagaggaagcagaaaaugauaucuguagguaugauuuuguggaaguugaagauauauccgaaaccaguaccauuauuagaggacgaugguguggacacaaggaaguuccuccaaggauaaaaucaagaacgaaccaaauuaaaaucacauucaaguccgaugacuacuuuguggcuaaaccuggauucaagauuuauuauucuuugcuggaagauuuccaacccgcagcagcuucagagaccaacugggaaucugucacaagcucuauuucagggguauccuauaacucuccaucaguaacggaucccacucugauugcggaugcucuggacaaaaaaauugcagaauuugauacaguggaagaucugcucaaguacuucaauccagagucauggcaagaagaucuugagaauauguaucuggacaccccucgguaucgaggcaggucauaccaugaccggaagucaaaaguugaccuggauaggcucaaugaugaugccaagcguuacaguugcacucccaggaauuacucggucaauauaagagaagagcugaaguuggccaauguggucuucuuuccacguugccuccucgugcagcgcuguggaggaaauuguggcuguggaacugucaacuggagguccugcacaugcaauucagggaaaaccgugaaaaaguaucaugagguauuacaguuugagccuggccacaucaagaggagggguagagcuaagaccauggcucuaguugacauccaguuggaucaccaugaacgaugugauuguaucugcagcucaagaccaccucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3892 - RNA, 1025 nt, Artificial Sequence
  mRNA product Design3 comprising derived and/or modified sequence from Homo sapiens__NP_003946.3__HsSOCS3 (wt)
gggagagucccgcagucggcguccagcggcucugcuuguucgugugugugucguugcaggccuuauucaagcuuaccauggucacccacagcaaguuucccgccgccgggaugagccgcccccuggacaccagccugcgccucaagaccuucagcuccaagagcgaguaccagcugguggugaacgcagugcgcaagcugcaggagagcggcuucuacuggagcgcagugaccggcggcgaggcgaaccugcugcucagugccgagcccgccggcaccuuucugauccgcgacagcucggaccagcgccacuucuucacgcucagcgucaagacccagucugggaccaagaaccugcgcauccagugugaggggggcagcuucucucugcagagcgauccccggagcacgcagcccgugccccgcuucgacugcgugcucaagcuggugcaccacuacaugccgcccccuggagcccccuccuuccccucgccaccuacugaacccuccuccgaggugcccgagcagccgucugcccagccacucccugggaguccccccagaagagccuauuacaucuacuccgggggcgagaagaucccccugguguugagccggccccucuccuccaacguggccacucuucagcaucucugucggaagaccgucaacggccaccuggacuccuaugagaaagucacccagcugccggggcccauucgggaguuccuggaccaguacgaugccccgcuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3893 - RNA, 830 nt, Artificial Sequence
  mRNA product Design3 comprising derived and/or modified sequence from Homo sapiens__NP_003227.1__HsTGFA (wt)
gggagagucccgcagucggcguccagcggcucugcuuguucgugugugugucguugcaggccuuauucaagcuuaccaugguccccucggcuggacagcucgcccuguucgcucuggguauuguguuggcugcgugccaggccuuggagaacagcacguccccgcugagugcagacccgcccguggcugcagcaguggugucccauuuuaaugacugcccagauucccacacucaguucugcuuccauggaaccugcagguuuuuggugcaggaggacaagccagcaugugucugccauucuggguacguuggugcacgcugugagcaugcggaccuccuggccgugguggcugccagccagaagaagcaggccaucaccgccuuggugguggucuccaucguggcccuggcuguccuuaucaucacaugugugcugauacacugcugccagguccgaaaacacugugaguggugccgggcccucaucugccggcacgagaagcccagcgcccuccugaagggaagaaccgcuugcugccacucagaaacaguggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3894 - RNA, 1520 nt, Artificial Sequence
  mRNA product Design3 comprising derived and/or modified sequence from Homo sapiens__NP_000651.3__HsTGFB1 (wt)
gggagagucccgcagucggcguccagcggcucugcuuguucgugugugugucguugcaggccuuauucaagcuuaccaugccgcccuccgggcugcggcugcugccgcugcugcuaccgcugcuguggcuacuggugcugacgccuggccggccggccgcgggacuauccaccugcaagacuaucgacauggagcuggugaagcggaagcgcaucgaggccauccgcggccagauccuguccaagcugcggcucgccagccccccgagccagggggaggugccgcccggcccgcugcccgaggccgugcucgcccuguacaacagcacccgcgaccggguggccggggagagugcagaaccggagcccgagccugaggccgacuacuacgccaaggaggucacccgcgugcuaaugguggaaacccacaacgaaaucuaugacaaguucaagcagaguacacacagcauauauauguucuucaacacaucagagcuccgagaagcgguaccugaacccguguugcucucccgggcagagcugcgucugcugaggcucaaguuaaaaguggagcagcacguggagcuguaccagaaauacagcaacaauuccuggcgauaccucagcaaccggcugcuggcacccagcgacucgccagagugguuaucuuuugaugucaccggaguugugcggcagugguugagccguggaggggaaauugagggcuuucgccuuagcgcccacugcuccugugacagcagggauaacacacugcaaguggacaucaacggguucacuaccggccgccgaggugaccuggccaccauucauggcaugaaccggccuuuccugcuucucauggccaccccgcuggagagggcccagcaucugcaaagcucccggcaccgccgagcccuggacaccaacuauugcuucagcuccacggagaagaacugcugcgugcggcagcuguacauugacuuccgcaaggaccucggcuggaaguggauccacgagcccaagggcuaccaugccaacuucugccucgggcccugccccuacauuuggagccuggacacgcaguacagcaagguccuggcccuguacaaccagcauaacccgggcgccucggcggcgccgugcugcgugccgcaggcgcuggagccgcugcccaucguguacuacgugggccgcaagcccaagguggagcagcuguccaacaugaucgugcgcuccugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3895 - RNA, 1592 nt, Artificial Sequence
  mRNA product Design3 comprising derived and/or modified sequence from Homo sapiens__NP_003229.1__HsTGFB2 (wt)
gggagagucccgcagucggcguccagcggcucugcuuguucgugugugugucguugcaggccuuauucaagcuuaccaugcacuacugugugcugagcgcuuuucugauccugcaucuggucacggucgcgcucagccugucuaccugcagcacacucgauauggaccaguucaugcgcaagaggaucgaggcgauccgcgggcagauccugagcaagcugaagcucaccagucccccagaagacuauccugagcccgaggaaguccccccggaggugauuuccaucuacaacagcaccagggacuugcuccaggagaaggcgagccggagggcggccgccugcgagcgcgagaggagcgacgaagaguacuacgccaaggagguuuacaaaauagacaugccgcccuucuuccccuccgaaaaugccaucccgcccacuuucuacagacccuacuucagaauuguucgauuugacgucucagcaauggagaagaaugcuuccaauuuggugaaagcagaguucagagucuuucguuugcagaacccaaaagccagagugccugaacaacggauugagcuauaucagauucucaaguccaaagauuuaacaucuccaacccagcgcuacaucgacagcaaaguugugaaaacaagagcagaaggcgaauggcucuccuucgauguaacugaugcuguucaugaauggcuucaccauaaagacaggaaccugggauuuaaaauaagcuuacacugucccugcugcacuuuuguaccaucuaauaauuacaucaucccaaauaaaagugaagaacuagaagcaagauuugcagguauugauggcaccuccacauauaccaguggugaucagaaaacuauaaaguccacuaggaaaaaaaacagugggaagaccccacaucuccugcuaauguuauugcccuccuacagacuugagucacaacagaccaaccggcggaagaagcgugcuuuggaugcggccuauugcuuuagaaaugugcaggauaauugcugccuacguccacuuuacauugauuucaagagggaucuaggguggaaauggauacacgaacccaaaggguacaaugccaacuucugugcuggagcaugcccguauuuauggaguucagacacucagcacagcaggguccugagcuuauauaauaccauaaauccagaagcaucugcuucuccuugcugcgugucccaagauuuagaaccucuaaccauucucuacuacauuggcaaaacacccaagauugaacagcuuucuaauaugauuguaaagucuugcaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3896 - RNA, 1586 nt, Artificial Sequence
  mRNA product Design3 comprising derived and/or modified sequence from Homo sapiens__NP_003230.1__HsTGFB3 (wt)
gggagagucccgcagucggcguccagcggcucugcuuguucgugugugugucguugcaggccuuauucaagcuuaccaugaagaugcacuugcaaagggcucuggugguccuggcccugcugaacuuugccacggucagccucucucuguccacuugcaccaccuuggacuucggccacaucaagaagaagaggguggaagccauuaggggacagaucuugagcaagcucaggcucaccagccccccugagccaacggugaugacccacguccccuaucagguccuggcccuuuacaacagcacccgggagcugcuggaggagaugcauggggagagggaggaaggcugcacccaggaaaacaccgagucggaauacuaugccaaagaaauccauaaauucgacaugauccaggggcuggcggagcacaacgaacuggcugucugcccuaaaggaauuaccuccaagguuuuccgcuucaauguguccucaguggagaaaaauagaaccaaccuauuccgagcagaauuccgggucuugcgggugcccaaccccagcucuaagcggaaugagcagaggaucgagcucuuccagauccuucggccagaugagcacauugccaaacagcgcuauaucgguggcaagaaucugcccacacggggcacugccgaguggcuguccuuugaugucacugacacugugcgugaguggcuguugagaagagaguccaacuuaggucuagaaaucagcauucacuguccaugucacaccuuucagcccaauggagauauccuggaaaacauucacgaggugauggaaaucaaauucaaaggcguggacaaugaggaugaccauggccguggagaucuggggcgccucaagaagcagaaggaucaccacaacccucaucuaauccucaugaugauucccccacaccggcucgacaacccgggccaggggggucagaggaagaagcgggcuuuggacaccaauuacugcuuccgcaacuuggaggagaacugcugugugcgcccccucuacauugacuuccgacaggaucugggcuggaaguggguccaugaaccuaagggcuacuaugccaacuucugcucaggcccuugcccauaccuccgcagugcagacacaacccacagcacggugcugggacuguacaacacucugaacccugaagcaucugccucgccuugcugcgugccccaggaccuggagccccugaccauccuguacuauguugggaggacccccaaaguggagcagcucuccaacaugguggugaagucuuguaaauguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3897 - RNA, 1733 nt, Artificial Sequence
  mRNA product Design3 comprising derived and/or modified sequence from Homo sapiens__NP_001057.1__HsTNFRSF1B (wt)
gggagagucccgcagucggcguccagcggcucugcuuguucgugugugugucguugcaggccuuauucaagcuuaccauggcgcccgucgccgucugggccgcgcuggccgucggacuggagcucugggcugcggcgcacgccuugcccgcccagguggcauuuacacccuacgccccggagcccgggagcacaugccggcucagagaauacuaugaccagacagcucagaugugcugcagcaaaugcucgccgggccaacaugcaaaagucuucuguaccaagaccucggacaccgugugugacuccugugaggacagcacauacacccagcucuggaacuggguucccgagugcuugagcuguggcucccgcuguagcucugaccagguggaaacucaagccugcacucgggaacagaaccgcaucugcaccugcaggcccggcugguacugcgcgcugagcaagcaggaggggugccggcugugcgcgccgcugcgcaagugccgcccgggcuucggcguggccagaccaggaacugaaacaucagacguggugugcaagcccugugccccggggacguucuccaacacgacuucauccacggauauuugcaggccccaccagaucuguaacgugguggccaucccugggaaugcaagcauggaugcagucugcacguccacgucccccacccggaguauggccccaggggcaguacacuuaccccagccaguguccacacgaucccaacacacgcagccaacuccagaacccagcacugcuccaagcaccuccuuccugcucccaaugggccccagccccccagcugaagggagcacuggcgacuucgcucuuccaguuggacugauugugggugugacagccuugggucuacuaauaauaggaguggugaacugugucaucaugacccaggugaaaaagaagcccuugugccugcagagagaagccaaggugccucacuugccugccgauaaggcccgggguacacagggccccgagcagcagcaccugcugaucacagcgccgagcuccagcagcagcucccuggagagcucggccagugcguuggacagaagggcgcccacucggaaccagccacaggcaccaggcguggaggccaguggggccggggaggcccgggccagcaccgggagcucagauucuuccccugguggccaugggacccaggucaaugucaccugcaucgugaacgucuguagcagcucugaccacagcucacagugcuccucccaagccagcuccacaaugggagacacagauuccagccccucggaguccccgaaggacgagcagguccccuucuccaaggaggaaugugccuuucggucacagcuggagacgccagagacccugcuggggagcaccgaagagaagccccugccccuuggagugccugaugcugggaugaagcccaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3898 - RNA, 860 nt, Artificial Sequence
  mRNA product Design3 comprising derived and/or modified sequence from Homo sapiens__NP_002623.2__HsPGF (wt)
gggagagucccgcagucggcguccagcggcucugcuuguucgugugugugucguugcaggccuuauucaagcuuaccaugccggucaugaggcuguucccuugcuuccugcagcuccuggccgggcuggcgcugccugcugugcccccccagcagugggccuugucugcugggaacggcucgucagagguggaagugguacccuuccaggaaguguggggccgcagcuacugccgggcgcuggagaggcugguggacgucguguccgaguaccccagcgagguggagcacauguucagcccauccugugucucccugcugcgcugcaccggcugcugcggcgaugagaaucugcacugugugccgguggagacggccaaugucaccaugcagcuccuaaagauccguucuggggaccggcccuccuacguggagcugacguucucucagcacguucgcugcgaaugccggccucugcgggagaagaugaagccggaaaggaggagacccaagggcagggggaagaggaggagagagaagcagagacccacagacugccaccugugcggcgaugcuguuccccggagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3899 - RNA, 1586 nt, Artificial Sequence
  mRNA product Design3 comprising derived and/or modified sequence from Homo sapiens__NP_001020537.2__HsVEGFA (wt)
gggagagucccgcagucggcguccagcggcucugcuuguucgugugugugucguugcaggccuuauucaagcuuaccaugacggacagacagacagacaccgcccccagccccagcuaccaccuccuccccggccggcggcggacaguggacgcggcggcgagccgcgggcaggggccggagcccgcgcccggaggcgggguggagggggucggggcucgcggcgucgcacugaaacuuuucguccaacuucugggcuguucucgcuucggaggagccgugguccgcgcgggggaagccgagccgagcggagccgcgagaagugcuagcucgggccgggaggagccgcagccggaggagggggaggaggaagaagagaaggaagaggagagggggccgcaguggcgacucggcgcucggaagccgggcucauggacgggugaggcggcggugugcgcagacagugcuccagccgcgcgcgcuccccaggcccuggcccgggccucgggccggggaggaagaguagcucgccgaggcgccgaggagagcgggccgccccacagcccgagccggagagggagcgcgagccgcgccggccccggucgggccuccgaaaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3900 - RNA, 1046 nt, Artificial Sequence
  mRNA product Design3 comprising derived and/or modified sequence from Homo sapiens__NP_001165094.1__HsVEGFA (wt)
gggagagucccgcagucggcguccagcggcucugcuuguucgugugugugucguugcaggccuuauucaagcuuaccaugaacuuucugcugucuugggugcauuggagccuugccuugcugcucuaccuccaccaugccaaguggucccaggcugcacccauggcagaaggaggagggcagaaucaucacgaaguggugaaguucauggaugucuaucagcgcagcuacugccauccaaucgagacccugguggacaucuuccaggaguacccugaugagaucgaguacaucuucaagccauccugugugccccugaugcgaugcgggggcugcugcaaugacgagggccuggagugugugcccacugaggaguccaacaucaccaugcagauuaugcggaucaaaccucaccaaggccagcacauaggagagaugagcuuccuacagcacaacaaaugugaaugcagaccaaagaaagauagagcaagacaagaaaaaaaaucaguucgaggaaagggaaaggggcaaaaacgaaagcgcaagaaaucccgguauaaguccuggagcguguacguuggugcccgcugcugucuaaugcccuggagccucccuggcccccaucccugugggccuugcucagagcggagaaagcauuuguuuguacaagauccgcagacguguaaauguuccugcaaaaacacagacucgcguugcaaggcgaggcagcuugaguuaaacgaacguacuugcagaugugacaagccgaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3901 - RNA, 971 nt, Artificial Sequence
  mRNA product Design3 comprising derived and/or modified sequence from Homo sapiens__NP_003368.1__HsVEGFB (wt)
gggagagucccgcagucggcguccagcggcucugcuuguucgugugugugucguugcaggccuuauucaagcuuaccaugagcccucugcuccgccgccugcugcucgccgcacuccugcagcuggcccccgcccaggccccugucucccagccugaugccccuggccaccagaggaaaguggugucauggauagauguguauacucgcgcuaccugccagccccgggaggugguggugcccuugacuguggagcucaugggcaccguggccaaacagcuggugcccagcugcgugacugugcagcgcugugguggcugcugcccugacgauggccuggagugugugcccacugggcagcaccaaguccggaugcagauccucaugauccgguacccgagcagucagcugggggagaugucccuggaagaacacagccagugugaaugcagaccuaaaaaaaaggacagugcugugaagccagacagggcugccacuccccaccaccguccccagccccguucuguuccgggcugggacucugcccccggagcacccuccccagcugacaucacccaucccacuccagccccaggccccucugcccacgcugcacccagcaccaccagcgcccugacccccggaccugccgcugccgcugccgacgccgcagcuuccuccguugccaagggcggggcuuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3902 - RNA, 1607 nt, Artificial Sequence
  mRNA product Design3 comprising derived and/or modified sequence from Homo sapiens__NP_005420.1__HsVEGFC (wt)
gggagagucccgcagucggcguccagcggcucugcuuguucgugugugugucguugcaggccuuauucaagcuuaccaugcacuugcugggcuucuucucuguggcguguucucugcucgccgcugcgcugcucccggguccucgcgaggcgcccgccgccgccgccgccuucgaguccggacucgaccucucggacgcggagcccgacgcgggcgaggccacggcuuaugcaagcaaagaucuggaggagcaguuacggucuguguccaguguagaugaacucaugacuguacucuacccagaauauuggaaaauguacaagugucagcuaaggaaaggaggcuggcaacauaacagagaacaggccaaccucaacucaaggacagaagagacuauaaaauuugcugcagcacauuauaauacagagaucuugaaaaguauugauaaugaguggagaaagacucaaugcaugccacgggagguguguauagauguggggaaggaguuuggagucgcgacaaacaccuucuuuaaaccuccauguguguccgucuacagauguggggguugcugcaauagugaggggcugcagugcaugaacaccagcacgagcuaccucagcaagacguuauuugaaauuacagugccucucucucaaggccccaaaccaguaacaaucaguuuugccaaucacacuuccugccgaugcaugucuaaacuggauguuuacagacaaguucauuccauuauuagacguucccugccagcaacacuaccacagugucaggcagcgaacaagaccugccccaccaauuacauguggaauaaucacaucugcagaugccuggcucaggaagauuuuauguuuuccucggaugcuggagaugacucaacagauggauuccaugacaucuguggaccaaacaaggagcuggaugaagagaccugucagugugucugcagagcggggcuucggccugccagcuguggaccccacaaagaacuagacagaaacucaugccagugugucuguaaaaacaaacucuuccccagccaauguggggccaaccgagaauuugaugaaaacacaugccaguguguauguaaaagaaccugccccagaaaucaaccccuaaauccuggaaaaugugccugugaauguacagaaaguccacagaaaugcuuguuaaaaggaaagaaguuccaccaccaaacaugcagcuguuacagacggccauguacgaaccgccagaaggcuugugagccaggauuuucauauagugaagaagugugucguugugucccuucauauuggaaaagaccacaaaugagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3903 - RNA, 1412 nt, Artificial Sequence
  mRNA product Design3 comprising derived and/or modified sequence from Homo sapiens__NP_004460.1__HsVEGFD (wt)
gggagagucccgcagucggcguccagcggcucugcuuguucgugugugugucguugcaggccuuauucaagcuuaccauguacagagaguggguaguggugaauguuuucaugauguuguacguccagcuggugcagggcuccaguaaugaacauggaccagugaagcgaucaucucaguccacauuggaacgaucugaacagcagaucagggcugcuucuaguuuggaggaacuacuucgaauuacucacucugaggacuggaagcuguggagaugcaggcugaggcucaaaaguuuuaccaguauggacucucgcucagcaucccaucgguccacuagguuugcggcaacuuucuaugacauugaaacacuaaaaguuauagaugaagaauggcaaagaacucagugcagcccuagagaaacgugcguggagguggccagugagcuggggaagaguaccaacacauucuucaagcccccuugugugaacguguuccgaugugguggcuguugcaaugaagagagccuuaucuguaugaacaccagcaccucguacauuuccaaacagcucuuugagauaucagugccuuugacaucaguaccugaauuagugccuguuaaaguugccaaucauacagguuguaagugcuugccaacagccccccgccauccauacucaauuaucagaagauccauccagaucccugaagaagaucgcuguucccauuccaagaaacucuguccuauugacaugcuaugggauagcaacaaauguaaauguguuuugcaggaggaaaauccacuugcuggaacagaagaccacucucaucuccaggaaccagcucucugugggccacacaugauguuugacgaagaucguugcgagugugucuguaaaacaccaugucccaaagaucuaauccagcaccccaaaaacugcaguugcuuugagugcaaagaaagucuggagaccugcugccagaagcacaagcuauuucacccagacaccugcagcugugaggacagaugccccuuucauaccagaccaugugcaaguggcaaaacagcaugugcaaagcauugccgcuuuccaaaggagaaaagggcugcccaggggccccacagccgaaagaauccuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3904 - RNA, 977 nt, Artificial Sequence
  mRNA product Design3 comprising derived and/or modified sequence from Homo sapiens__NP_061986.1__HsFGF21 (opt1)
gggagagucccgcagucggcguccagcggcucugcuuguucgugugugugucguugcaggccuuauucaagcuuaccauggacagcgacgagaccggcuucgagcacuccgggcugugggugagcguccucgccggccugcugcucggggccugccaggcccaccccaucccggacuccagcccccugcugcaguucggcggccaggugcgccagcgguaccucuacaccgacgacgcccagcagacggaggcccaccuggagauccgcgaggacgggaccgugggcggggccgccgaccagucccccgagagccugcuccagcugaaggcgcugaagcccggcgucauccagauccucggggugaagaccucccgguuccugugccagcgcccggacggcgcccuguacgggagccuccacuucgaccccgaggccugcuccuuccgggagcugcugcucgaggacggcuacaacguguaccagagcgaggcccacggccugccccugcaccuccccgggaacaaguccccgcaccgcgaccccgcgccccggggccccgcccgcuuccugccgcugcccgggcucccgcccgcccugcccgagccgcccggcauccuggcgccccagccgcccgacgucggcagcuccgacccccucagcaugguggggcccucccagggccggagccccuccuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3905 - RNA, 1757 nt, Artificial Sequence
  mRNA product Design3 comprising derived and/or modified sequence from Homo sapiens__NP_002412.1__HsMMP1 (opt1)
gggagagucccgcagucggcguccagcggcucugcuuguucgugugugugucguugcaggccuuauucaagcuuaccaugcacagcuucccgccccugcuccugcugcucuucuggggcguggucucccacagcuuccccgccacccuggagacccaggagcaggacguggaccuggugcagaaguaccucgagaaguacuacaaccugaagaacgacgggcgccaggucgagaagcggcgcaacuccggccccgugguggagaagcugaagcagaugcaggaguucuucgggcucaaggucacgggcaagcccgacgccgagacccugaaggugaugaagcagccgcggugcggggugcccgacgucgcgcaguucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3906 - RNA, 1517 nt, Artificial Sequence
  mRNA product Design3 comprising derived and/or modified sequence from Homo sapiens__NP_002412.1__HsMMP1(1-19,100-469) (opt1)
gggagagucccgcagucggcguccagcggcucugcuuguucgugugugugucguugcaggccuuauucaagcuuaccaugcacagcuucccgccccugcuccugcugcucuucuggggcguggucucccacagcuucgugcugaccgagggcaacccccgcugggagcagacccaccucacguaccggaucgagaacuacacccccgaccugccgcgcgccgacguggaccacgccaucgagaaggccuuccagcuguggagcaacgucaccccgcucaccuucacgaagguguccgagggccaggccgacaucaugaucagcuucgugcggggcgaccaccgcgacaacucccccuucgacgggcccgggggcaaccuggcgcacgccuuccagccggggcccggcaucggcggggacgcccacuucgacgaggacgagcgguggaccaacaacuuccgcgaguacaaccugcaccgggucgccgcgcacgagcucggccacagccuggggcugucccacagcaccgacaucggcgcccucauguaccccuccuacaccuucagcggcgacgugcagcuggcccaggacgacaucgacgggauccaggccaucuacggccgcucccagaaccccgugcagccgaucgggccccagacgcccaaggccugcgacagcaagcugaccuucgacgcgaucaccaccauccggggcgaggucauguucuucaaggaccgcuucuacaugcggacgaaccccuucuacccggagguggagcucaacuucaucuccguguucuggccccagcugcccaacgggcuggaggccgccuacgaguucgccgaccgcgacgagguccgguucuucaagggcaacaaguacugggccgugcagggccagaacgugcuccacggguaccccaaggacaucuacagcuccuucggcuucccgcgcaccgucaagcacaucgacgcggcccugagcgaggagaacaccgggaagaccuacuucuucguggccaacaaguacuggcgguacgacgaguacaagcgcuccauggaccccggcuaccccaagaugaucgcccacgacuuccccgggaucggccacaaggucgacgccguguucaugaaggacggcuucuucuacuucuuccacgggacgcggcaguacaaguucgacccgaagaccaagcgcauccugacccuccagaaggcgaacagcugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3907 - RNA, 3704 nt, Artificial Sequence
  mRNA product Design3 comprising derived and/or modified sequence from Clostridium histolyticum__BAA77453.1__ColG (opt1)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3908 - RNA, 3428 nt, Artificial Sequence
  mRNA product Design3 comprising derived and/or modified sequence from Clostridium histolyticum__BAA77453.1__HsALB(1-18)_ColG(111-1118) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3909 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3910 - RNA, 3452 nt, Artificial Sequence
  mRNA product Design3 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaacuuccugaagaucauccucaaccgcggcaagaccaugaagcggaagugccugagcaagcgccugaugcucgccaucaccauggccacgaucuucaccgugaacuccacccugcccaucuacgcggccgucgacaagaacaacgccaccgccgccgugcagaacgagagcaagcgguacacgguguccuaccugaagacccucaacuacuacgaccuggucgaccugcucgugaagaccgagaucgagaaccugccggaccuguuccaguacagcuccgacgcgaaggaguucuacgggaacaagacccgcaugagcuucaucauggacgagaucggccggcgcgcgccccaguacacggagaucgaccacaaggggauccccacccucguggaggucgugcgggccggcuucuaccugggguuccacaacaaggagcugaacgagaucaacaagcgcuccuucaaggagcgggugauccccagcauccucgccauccagaagaacccgaacuucaagcugggcaccgagguccaggacaagaucguguccgccaccggccugcucgccgggaacgagacggccccgcccgagguggucaacaacuucacccccauccugcaggacugcaucaagaacaucgaccgcuacgcccuggacgaccucaagagcaaggcccuguucaacgugcuggcggccccgaccuacgacaucaccgaguaccuccgggccacgaaggagaagcccgagaacacccccugguacggcaagaucgacggguucaucaacgagcugaagaagcuggcccucuacggcaagaucaacgacaacaacuccuggaucaucgacaacgggaucuaccacaucgcgccccugggcaagcugcacagcaacaacaagaucggcaucgagacccucaccgaggugaugaaggucuacccguaccuguccaugcagcaccuccagagcgccgaccagaucaagcgccacuacgacuccaaggacgccgaggggaacaagaucccccuggacaaguucaagaaggagggcaaggagaaguacugccccaagacguacaccuucgacgacgggaaggugaucaucaaggccggcgcccggguggaggaggagaaggucaagcgccuguacugggccagcaaggaggugaacucccaguucuuccggguguacggcaucgacaagccccuggaggaggggaacccggacgacauccucaccauggucaucuacaacagccccgaggaguacaagcugaacuccgugcuguacggcuacgacaccaacaacgggggcauguacaucgagcccgaggggacguucuucaccuacgagcgcgaggcgcaggagagcaccuacacccucgaggagcuguuccggcacgaguacacgcacuaccugcagggccgcuacgccgugcccggccagugggggcggaccaagcucuacgacaacgaccgccugaccugguacgaggagggcggggccgagcuguucgccggcagcacccggacguccgggauccucccgcgcaagagcaucgucuccaacauccacaacaccacccgcaacaaccgguacaagcugagcgacaccgugcacuccaaguacggcgccagcuucgaguucuacaacuacgcgugcauguucauggacuacauguacaacaaggacaugggcauccugaacaagcucaacgaccuggccaagaacaacgacgucgacggguacgacaacuacauccgcgaccuguccagcaacuacgcccugaacgacaaguaccaggaccacaugcaggagcggaucgacaacuacgagaaccucacggugcccuucguggccgacgacuaccugguccgccacgcguacaagaaccccaacgagaucuacuccgagaucagcgagguggccaagcugaaggacgccaaguccgaggugaagaagucccaguacuucagcaccuucacccuccggggcagcuacaccgggggcgccuccaaggggaagcuggaggaccagaaggccaugaacaaguucaucgacgacagccugaagaagcucgacaccuacuccuggagcggcuacaagacgcugaccgcguacuucaccaacuacaaggucgacuccagcaaccgcgugaccuacgacguggucuuccacggcuaccugcccaacgagggggacagcaagaacucccucccguacggcaagaucaacgggacguacaagggcaccgagaaggagaagaucaaguucagcuccgagggcagcuucgaccccgacgggaagaucguguccuacgagugggacuucggcgacgggaacaagagcaacgaggagaaccccgagcacuccuacgacaaggugggcaccuacaccgucaagcugaaggugacggacgacaagggggagagcuccgugagcaccaccaccgccgagaucaaggaccuguccgagaacaagcuccccgucaucuacaugcacgugcccaagagcggcgcccugaaccagaagguggucuucuacggcaaggggacguacgaccccgacggcuccaucgccggguaccagugggacuucggcgacgggagcgacuucuccagcgagcagaaccccucccacguguacaccaagaagggcgaguacaccgugacccugcgggucauggacagcagcggccagauguccgagaagacgaugaagaucaagaucaccgacccgguguaccccaucgggaccgagaaggagcccaacaacagcaaggagaccgccuccggccccaucgugccggggauccccgucagcggcacgaucgagaacaccuccgaccaggacuacuucuacuucgacgugaucacccccggggaggugaagaucgacaucaacaagcucggcuacggcggggcgaccugggucguguacgacgagaacaacaacgccgugagcuacgccacggacgacggccagaaccuguccgggaaguucaaggccgacaagcccggccgcuacuacauccaccuguacauguucaacgggagcuacaugccguaccggaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3911 - RNA, 3413 nt, Artificial Sequence
  mRNA product Design3 comprising derived and/or modified sequence from Clostridium histolyticum__BAA34542.1__ColH (opt1)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3912 - RNA, 3347 nt, Artificial Sequence
  mRNA product Design3 comprising derived and/or modified sequence from Clostridium histolyticum__BAA34542.1__HsALB(1-18)_ColH(41-1021) (opt1)
gggagagucccgcagucggcguccagcggcucugcuuguucgugugugugucguugcaggccuuauucaagcuuaccaugaagugggugaccuucaucagccugcucuuccuguucuccagcgccuacuccgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3913 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt1)
gggagagucccgcagucggcguccagcggcucugcuuguucgugugugugucguugcaggccuuauucaagcuuaccaugaagugggugaccuucaucagccugcucuuccuguucuccagcgccuacuccaugaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3914 - RNA, 923 nt, Artificial Sequence
  mRNA product Design3 comprising derived and/or modified sequence from Homo sapiens__NP_001133.1__HsAMELX (opt1)
gggagagucccgcagucggcguccagcggcucugcuuguucgugugugugucguugcaggccuuauucaagcuuaccaugggcaccuggauccuguucgccugccuccugggggccgcguucgccaugccccugccgccccaccccggccaccccggguacaucaacuucagcuacgaggugcucaccccgcugaagugguaccaguccauccgcccgcccuaccccagcuacggcuacgagcccaugggcggguggcugcaccaccagaucauccccguccucucccagcagcacccgcccacgcacacccugcagccgcaccaccacauccccguggugcccgcccagcagcccgucaucccccagcagcccaugaugcccgugcccggccagcacagcaugaccccgauccagcaccaccagcccaaccugcccccgccggcccagcagcccuaccagccccagcccgugcagccccagccccaccagcccaugcagccgcagccgcccguccaccccaugcagccgcucccgccccagcccccgcugccgcccauguuccccaugcagccccugccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3915 - RNA, 482 nt, Artificial Sequence
  mRNA product Design3 comprising derived and/or modified sequence from Homo sapiens__NP_001133.1__HsAMELX-TRAP (opt1)
gggagagucccgcagucggcguccagcggcucugcuuguucgugugugugucguugcaggccuuauucaagcuuaccaugccccugccgccccaccccggccaccccggguacaucaacuucagcuacgaggugcucaccccgcugaagugguaccaguccauccgcccgcccuaccccagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3916 - RNA, 515 nt, Artificial Sequence
  mRNA product Design3 comprising derived and/or modified sequence from Homo sapiens__NP_001133.1__HsAMELX-LRAP (opt1)
gggagagucccgcagucggcguccagcggcucugcuuguucgugugugugucguugcaggccuuauucaagcuuaccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3917 - RNA, 554 nt, Artificial Sequence
  mRNA product Design3 comprising derived and/or modified sequence from Homo sapiens__NP_001133.1__HLA-A2-SP_HsAMELX(17-60) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgcccuaccccagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3918 - RNA, 587 nt, Artificial Sequence
  mRNA product Design3 comprising derived and/or modified sequence from Homo sapiens__NP_001133.1__HLA-A2-SP_HsAMELX(17-47,168-191) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3919 - RNA, 926 nt, Artificial Sequence
  mRNA product Design3 comprising derived and/or modified sequence from Homo sapiens__NP_001134.1__HsAMELY (opt1)
gggagagucccgcagucggcguccagcggcucugcuuguucgugugugugucguugcaggccuuauucaagcuuaccaugggcaccuggauccuguucgccugccucgugggggccgcguucgccaugccccugccgccccaccccggccaccccggguacaucaacuucagcuacgagguccugaccccgcucaagugguaccaguccaugauccgcccgcccuacagcuccuacggcuacgagcccaugggcggguggcugcaccaccagaucauccccguggugagccagcagcacccccugacgcacacccuccagucccaccaccacauccccgucgugcccgcccagcagccgcgggugcgccagcaggcccugaugcccguccccggccagcagagcaugacccccacccagcaccaccagccgaaccugccccuccccgcccagcagcccuuccagccgcagcccgugcagccccagccccaccagccgaugcagccccagccgcccgugcagcccaugcagccccugcugccccagccgccccucccgcccauguucccccugcggccccugccgcccauccuccccgaccugcaccuggaggcguggcccgccacggacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3920 - RNA, 485 nt, Artificial Sequence
  mRNA product Design3 comprising derived and/or modified sequence from Homo sapiens__NP_001134.1__HsAMELY-TRAP (opt1)
gggagagucccgcagucggcguccagcggcucugcuuguucgugugugugucguugcaggccuuauucaagcuuaccaugccccugccgccccaccccggccaccccggguacaucaacuucagcuacgagguccugaccccgcucaagugguaccaguccaugauccgcccgcccuacagcuccuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3921 - RNA, 518 nt, Artificial Sequence
  mRNA product Design3 comprising derived and/or modified sequence from Homo sapiens__NP_001134.1__HsAMELY-LRAP (opt1)
gggagagucccgcagucggcguccagcggcucugcuuguucgugugugugucguugcaggccuuauucaagcuuaccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3922 - RNA, 557 nt, Artificial Sequence
  mRNA product Design3 comprising derived and/or modified sequence from Homo sapiens__NP_001134.1__HLA-A2-SP_HsAMELY(17-61) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgcccuacagcuccuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3923 - RNA, 590 nt, Artificial Sequence
  mRNA product Design3 comprising derived and/or modified sequence from Homo sapiens__NP_001134.1__HLA-A2-SP_HsAMELY(17-48,169-192) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgagguccugaccccgcucaagugguaccaguccaugauccgcccgccgcccauccuccccgaccugcaccuggaggcguggcccgccacggacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3924 - RNA, 917 nt, Artificial Sequence
  mRNA product Design3 comprising derived and/or modified sequence from Sus scrofa__NP_999071.1__SsAMELX-001-1 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccuacacgagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugcccccgauguucuccaugcagagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3925 - RNA, 485 nt, Artificial Sequence
  mRNA product Design3 comprising derived and/or modified sequence from Sus scrofa__NP_999071.1__SsAMELX-TRAP (opt1)
gggagagucccgcagucggcguccagcggcucugcuuguucgugugugugucguugcaggccuuauucaagcuuaccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3926 - RNA, 518 nt, Artificial Sequence
  mRNA product Design3 comprising derived and/or modified sequence from Sus scrofa__NP_999071.1__SsAMELX-LRAP (opt1)
gggagagucccgcagucggcguccagcggcucugcuuguucgugugugugucguugcaggccuuauucaagcuuaccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3927 - RNA, 557 nt, Artificial Sequence
  mRNA product Design3 comprising derived and/or modified sequence from Sus scrofa__NP_999071.1__HLA-A2-SP_SsAMEL(17-61) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3928 - RNA, 590 nt, Artificial Sequence
  mRNA product Design3 comprising derived and/or modified sequence from Sus scrofa__NP_999071.1__HLA-A2-SP_SsAMEL(17-49,167-189) (opt1)
gggagagucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3929 - RNA, 881 nt, Artificial Sequence
  mRNA product Design3 comprising derived and/or modified sequence from Sus scrofa__P45561-2__SsAMELX-001-2 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacauccgccacccguacaccagcuacggcuacgagcccaugggcggguggcuccaccaccagaucauccccguggucucccagcagacgccccagagccacgcccugcagccgcaccaccacauccccauggugcccgcccagcagcccggcaucccgcagcagcccaugaugccccugcccgggcagcacuccaugaccccgacccagcaccaccagcccaaccucccccugcccgcccagcagccguuccagccccagcccgugcagccccagccgcaccagccccugcagccccagagccccaugcacccgauccagccccuccugccccagccgccccugccgcccauguucuccaugcagagccuccugcccgaccugccccucgaggccuggcccgcgaccgacaagacgaagcgggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3930 - RNA, 917 nt, Artificial Sequence
  mRNA product Design3 comprising derived and/or modified sequence from Sus scrofa__NP_998965.1__SsAMELX-001-3 (opt1)
gggagagucccgcagucggcguccagcggcucugcuuguucgugugugugucguugcaggccuuauucaagcuuaccaugggcaccuggaucuucuucgccugccugcucggggccagccuggcgaugccccugccgccccaccccggccaccccggguacaucaacuucuccuacgaggugcucacgccccugaagugguaccagaacaugauccgccaccccuacaccagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugccgcccauguucuccaugcagagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3931 - RNA, 566 nt, Artificial Sequence
  mRNA product Design3 comprising derived and/or modified sequence from Sus scrofa__K7GPB2__SsAMELX-002 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccagccugcuccccgaccugccccuggaggccuggccggccacggacaagaccaagcgggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3932 - RNA, 959 nt, Artificial Sequence
  mRNA product Design3 comprising derived and/or modified sequence from Sus scrofa__K7GLD0__SsAMELX-003 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggaccucuaccuggaggccauccgcaucgaccggaccgccuucgugcugacgccccucaagugguaccagaacaugauccgccaccccuacaccagcuacggcuacgagcccaugggcggguggcugcaccaccagaucauccccgucgugucccagcagaccccgcagagccacgcccugcagccccaccaccacauccccauggugcccgcccagcagccgggcaucccccagcagcccaugaugccccucccggggcagcacuccaugacccccacgcagcaccaccagcccaaccugccccugccggcgcagcagcccuuccagccccagcccguccagccgcagccccaccagccccuccagccccagagcccgaugcaccccauccagccccugcugccgcagccgccccugccgcccauguucuccaugcagagccuccugcccgaccucccccuggaggccuggcccgccaccgacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3933 - RNA, 845 nt, Artificial Sequence
  mRNA product Design3 comprising derived and/or modified sequence from Sus scrofa__K7GPE9__SsAMELX-004 (opt1)
gggagagucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccacgccccagagccacgcccugcagccccaccaccacaucccgaugguccccgcccagcagcccggcaucccccagcagccgaugaugccccuccccgggcagcacuccaugacccccacccagcaccaccagccgaaccugccccugcccgcccagcagcccuuccagccgcagcccgugcagccccagccccaccagccgcuccagccccagagccccaugcaccccauccagccgcugcugccccagcccccgcucccgcccauguucuccaugcagagccugcugcccgaccucccccuggaggccuggcccgcgaccgacaagacgaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3934 - RNA, 869 nt, Artificial Sequence
  mRNA product Design3 comprising derived and/or modified sequence from Sus scrofa__J9JIM4__SsAMELX-201 (opt1)
gggagagucccgcagucggcguccagcggcucugcuuguucgugugugugucguugcaggccuuauucaagcuuaccaugccccugccgccccaccccggccaccccggguacaucaacuucagcuacgaggugcucaccccgcugaagugguaccagaacaugauccgccaccccuacaccuccuacggcuacgagcccaugggcggguggcugcaccaccagaucauccccgucgugagccagcagacgccgcagucccacgcccuccagccccaccaccacauccccauggugcccgcccagcagcccgggaucccccagcagcccaugaugccccugccgggccagcacagcaugacccccacccagcaccaccagcccaaccugccccucccggcgcagcagcccuuccagccccagcccguccagccgcagccccaccagccccugcagccccaguccccgaugcaccccauccagccccugcucccgcagccgccccugccgcccauguucagcaugcagucccugcuccccgaccugccccuggaggccuggcccgccaccgacaagacgaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3935 - RNA, 3308 nt, Artificial Sequence
  mRNA product Design3 comprising derived and/or modified sequence from Homo sapiens__NP_006120.1__HsBMP1 (opt1)
gggagagucccgcagucggcguccagcggcucugcuuguucgugugugugucguugcaggccuuauucaagcuuaccaugcccggcguggcccgccugccgcuccugcuggggcuccugcugcucccccggcccggccgcccccuggaccuggccgacuacaccuacgaccucgccgaggaggacgacagcgagccgcugaacuacaaggaccccugcaaggccgccgccuuccugggggacaucgcccucgacgaggaggaccugcgggcguuccagguccagcaggccguggaccugcgccggcacaccgcccgcaaguccagcaucaaggccgcggugcccggcaacacguccacccccagcugccaguccaccaacgggcagccgcagcggggcgccugcggccgcuggcgggggcgcagccggucccgccgggccgccaccagccgccccgagcgggucuggcccgacggcgugauccccuucgugaucgggggcaacuucacggggucccagcgcgccgucuuccggcaggcgaugcgccacugggagaagcacacgugcgugaccuuccucgagcggaccgacgaggacagcuacaucguguucaccuaccgcccgugcggcugcugcuccuacgucggccggcgcgggggcgggccccaggccaucagcaucggcaagaacugcgacaaguucggcaucguggugcacgagcuggggcacgucgugggcuucuggcacgagcacacccgccccgaccgggaccgccacguguccaucguccgggagaacauccagcccgggcaggaguacaacuuccugaagauggagccgcaggagguggagagccucggcgagaccuacgacuucgacuccaucaugcacuacgcccgcaacaccuucagccgggggaucuuccuggacacgaucgugcccaaguacgaggucaacggcgugaagccgcccaucggccagcgcacccggcuguccaagggggacaucgcccaggcccgcaagcucuacaagugccccgcgugcggcgagacccugcaggacagcaccgggaacuucuccagccccgaguaccccaacggcuacagcgcccacaugcacugcguguggcggaucuccgucacgcccggggagaagaucauccugaacuucaccagccucgaccuguaccgcucccggcugugcugguacgacuacguggaggugcgcgacggcuucuggcggaaggccccgcuccgcggccgguucugcgggagcaagcugcccgagcccaucgucuccaccgacagccgccuguggguggaguuccgguccagcuccaacugggucggcaagggguucuucgccguguacgaggccaucugcggcggggacgugaagaaggacuacggccacauccagagccccaacuacccggacgacuaccgccccuccaaggucugcaucuggcggauccaggugagcgagggcuuccacguggggcucaccuuccaguccuucgagaucgagcgccacgacagcugcgcguacgacuaccuggagguccgcgacggccacuccgagagcuccacgcugaucgggcgguacugcggcuacgagaagcccgacgacaucaagagcaccuccagccgccucuggcugaaguucgugagcgacggcuccaucaacaaggccggguucgccgugaacuucuucaaggaggucgacgagugcagccggccgaaccgcggcgggugcgagcagcggugccugaacacccucggcuccuacaagugcagcugcgaccccggguacgagcuggcccccgacaagcgccggugcgaggccgcgugcggcggcuuccugaccaagcucaacggguccaucacgagccccggcuggccgaaggaguacccgcccaacaagaacugcaucuggcagcugguggcccccacccaguaccgcaucucccugcaguucgacuucuucgagaccgaggggaacgacgugugcaaguacgacuucgucgaggugcggagcggccucaccgccgacuccaagcugcacgggaaguucugcggcagcgagaagcccgaggugaucacgucccaguacaacaacaugcgcgucgaguucaagagcgacaacaccguguccaagaagggcuucaaggcccacuucuucagcgacaaggacgagugcuccaaggacaacgggggcugccagcaggacugcgugaacaccuucgggagcuacgagugccagugccgguccggcuucguccugcacgacaacaagcacgacugcaaggaggcggggugcgaccacaaggugaccagcacgagcggcaccaucaccucccccaacuggcccgacaaguaccccagcaagaaggagugcaccugggccaucuccagcacgccgggccaccgcgugaagcucaccuucauggagauggacaucgagucccagcccgagugcgccuacgaccaccuggaggucuucgacgggcgggacgccaaggcccccgugcugggccgcuucugcgggagcaagaagcccgagccggugcucgcgaccggcucccggauguuccugcgcuucuacagcgacaacuccguccagcggaagggguuccaggccagccacgccaccgagugcggcggccaggugcgcgccgacgugaagaccaaggaccuguacucccacgcccaguucggggacaacaacuaccccggcggggucgacugcgagugggugaucguggcggaggagggcuacggcgucgagcugguguuccagacguucgagguggaggaggagaccgacugcggguacgacuacauggagcuguucgacggcuacgacagcaccgcgccccggcucgggcgcuacugcggcuccgggcccccggaggaggucuacagcgccggcgacuccgugcuggugaaguuccacagcgacgacaccaucacgaagaagggcuuccaccuccgguacaccuccaccaaguuccaggacacccugcacagccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3936 - RNA, 1538 nt, Artificial Sequence
  mRNA product Design3 comprising derived and/or modified sequence from Homo sapiens__NP_001191.1__HsBMP2 (opt1)
gggagagucccgcagucggcguccagcggcucugcuuguucgugugugugucguugcaggccuuauucaagcuuaccaugguggccggcacccgcugccugcucgcccugcugcucccccagguccugcucgggggcgcggccgggcuggugccggagcugggccggcgcaaguucgccgccgccagcuccgggcggcccagcucccagcccagcgacgaggugcuguccgaguucgagcuccgccugcugagcauguucggccucaagcagcggcccaccccgucccgcgacgcggucgugccgcccuacaugcuggaccuguaccggcgccacagcggccagcccgggucccccgcccccgaccaccggcucgagcgcgccgccagccgggcgaacacggugcgcuccuuccaccacgaggagagccuggaggagcugcccgagaccuccggcaagaccacccggcgcuucuucuucaaccucagcuccauccccacggaggaguucaucaccagcgccgagcugcaggucuuccgggagcagaugcaggacgcccuggggaacaacuccagcuuccaccaccgcaucaacaucuacgagaucaucaagccggccaccgccaacuccaaguuccccgugacccggcuccuggacacgcgccuggugaaccagaacgcgagccggugggagagcuucgacgucacccccgccgugaugcgcuggaccgcccagggccacgccaaccacggguucguggucgagguggcccaccucgaggagaagcagggcguguccaagcggcacguccgcaucagccgcucccugcaccaggacgagcacagcuggucccagauccggccccugcucgugaccuucggccacgacgggaagggccacccgcugcacaagcgcgagaagcggcaggcgaagcacaagcagcgcaagcggcucaagagcuccugcaagcgccacccccuguacguggacuucagcgacgucggguggaacgacuggaucguggccccgcccggcuaccacgccuucuacugccacggcgagugccccuucccccuggccgaccaccugaacuccacgaaccacgccaucgugcagacccucgucaacagcgugaacuccaagauccccaaggcgugcugcgugcccaccgagcugagcgccaucuccaugcuguaccucgacgagaacgagaaggucgugcugaagaacuaccaggacauggucguggaggggugcggcugccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3937 - RNA, 1574 nt, Artificial Sequence
  mRNA product Design3 comprising derived and/or modified sequence from Homo sapiens__NP_001193.2__HsBMP4 (opt1)
gggagagucccgcagucggcguccagcggcucugcuuguucgugugugugucguugcaggccuuauucaagcuuaccaugauccccggcaaccgcaugcugauggugguccuccugugccaggugcugcucgggggcgccagccacgccucccugaucccggagaccgggaagaagaagguggcggagauccagggccacgccgggggccggcgcagcggccagucccacgagcugcuccgggacuucgaggccacccugcugcagauguucgggcuccgccggcgcccccagcccagcaaguccgccgucauccccgacuacaugcgggaccuguaccgccugcagagcggcgaggaggaggaggagcagauccacuccacggggcucgaguacccggagcggcccgccagccgcgcgaacaccgugcgguccuuccaccacgaggagcaccuggagaacauccccggcaccagcgagaacuccgccuuccgcuuccuguucaaccucagcuccauccccgagaacgaggugaucagcuccgccgagcugcggcuguuccgcgagcaggucgaccaggggccggacugggagcggggcuuccaccgcaucaacaucuacgaggugaugaagccgcccgccgaggugguccccggccaccucaucacccggcugcuggacacgcgccucgugcaccacaacgugacccggugggagaccuucgacgucagccccgcggugcugcgcuggacccgggagaagcagcccaacuacgggcuggccaucgaggugacgcaccuccaccagacccgcacccaccagggccagcacguccgcaucucccggagccugccccagggguccggcaacugggcccagcugcgcccccuccuggugaccuucggccacgacgggcggggccacgcccugacgcgccggcgccgggccaagcgcagcccgaagcaccacagccagcgggcgcgcaagaagaacaagaacugccggcgccacucccucuacguggacuucagcgacgucggguggaacgacuggaucguggccccgcccggcuaccaggccuucuacugccacggggacugccccuucccccuggccgaccaccugaacuccaccaaccacgccaucgugcagacccucgucaacagcgugaacuccagcauccccaaggcgugcugcgugcccaccgagcuguccgccaucagcaugcuguaccucgacgaguacgacaaggucgugcugaagaacuaccaggagauggucguggagggcugcggcugccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3938 - RNA, 1889 nt, Artificial Sequence
  mRNA product Design3 comprising derived and/or modified sequence from Homo sapiens__NP_001709.1__HsBMP6 (opt1)
gggagagucccgcagucggcguccagcggcucugcuuguucgugugugugucguugcaggccuuauucaagcuuaccaugcccggccuggggcgccgggcccaguggcucugcuggugguggggccugcugugcagcugcugcgggccgccgccccuccggccgccccugcccgccgcggccgccgccgccgcgggcgggcagcugcucggcgacggcgggucccccggccggaccgagcagcccccgcccagcccccaguccagcuccggguuccuguaccgccggcugaagacccaggagaagcgcgagaugcagaaggagauccucagcgugcugggccugccccaccggccccgcccccuccacgggcugcagcagccccagcccccggcccugcggcagcaggaggagcagcagcagcagcagcagcucccccgcggcgagcccccgcccggccggcugaaguccgcgccccuguucaugcucgaccuguacaacgcccugagcgccgacaacgacgaggacggggccuccgagggcgagcgccagcagagcuggccccacgaggccgccuccagcucccagcggcgccagcccccgcccggggccgcgcacccccucaaccgcaagagccugcuggcccccggcuccggcagcgggggcgccuccccgcucacgagcgcccaggacuccgccuuccugaacgacgcggacauggucaugagcuucgugaaccugguggaguacgacaaggaguucagcccccgccagcggcaccacaaggaguucaaguucaaccucucccagauccccgagggggaggucgugaccgccgccgaguuccgcaucuacaaggacugcgugaugggcagcuucaagaaccagaccuuccugaucuccaucuaccagguccugcaggagcaccagcaccgggacagcgaccucuuccugcuggacacccgcguggugugggccuccgaggagggguggcucgaguucgacaucacggccaccagcaaccugugggucgugaccccgcagcacaacaugggccugcagcucuccguggucacccgggacggcgugcacgugcacccccgcgcggccgggcuggucggccgcgacgggcccuacgacaagcagcccuucaugguggccuucuucaaggugagcgagguccacgugcggacgacccgcuccgccagcucccggcgccggcagcagagccgcaaccgguccacccagagccaggacguggcccgcgucuccagcgcguccgacuacaacagcuccgagcugaagaccgccugccggaagcacgagcucuacgugagcuuccaggaccugggcuggcaggacuggaucaucgccccgaagggguacgccgcgaacuacugcgacggcgagugcagcuucccccugaacgcccacaugaacgccacgaaccacgccaucgugcagacccucguccaccugaugaaccccgaguacgugcccaagccgugcugcgcccccaccaagcugaacgcgaucuccguccucuacuucgacgacaacagcaacgugauccugaagaaguaccgcaacauggugguccgggccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3939 - RNA, 1643 nt, Artificial Sequence
  mRNA product Design3 comprising derived and/or modified sequence from Homo sapiens__NP_001710.1__HsBMP7 (opt1)
gggagagucccgcagucggcguccagcggcucugcuuguucgugugugugucguugcaggccuuauucaagcuuaccaugcacgugcgcagccugcgggccgccgcgccccacuccuucgucgcccucugggccccgcuguuccugcuccgcagcgcccuggccgacuucucccuggacaacgaggugcacagcuccuucauccaccggcgccuccggagccaggagcgccgggagaugcagcgcgagauccuguccauccugggccucccccaccggccccgcccccaccuccaggggaagcacaacagcgcgccgauguucaugcuggaccuguacaacgccauggccguggaggagggcgggggccccgggggccagggcuucuccuaccccuacaaggccgucuucagcacccaggggcccccgcuggcgucccugcaggacagccacuuccucaccgacgccgacauggugauguccuucgugaaccuggucgagcacgacaaggaguucuuccacccccgguaccaccaccgcgaguuccgguucgaccugagcaagauccccgagggcgaggccgugacggccgccgaguuccgcaucuacaaggacuacauccgggagcgcuucgacaacgagaccuuccggaucuccguguaccagguccuccaggagcaccuggggcgcgagagcgaccuguuccuccuggacucccggacccugugggcgagcgaggagggcuggcucguguucgacaucaccgccacguccaaccacuggguggucaacccccgccacaaccuggggcugcagcucagcguggagacccuggacggccagagcaucaacccgaagcuggccggccucaucgggcggcacggcccccagaacaagcagcccuucaugguggccuucuucaaggccaccgagguccacuuccgcuccauccgcagcaccggguccaagcagcggagccagaaccgcuccaagacgcccaagaaccaggaggcgcugcggauggccaacguggccgagaacagcuccagcgaccagcgccaggccugcaagaagcacgagcuguacguguccuuccgggaccucggcuggcaggacuggaucaucgccccggagggcuacgcggccuacuacugcgagggggagugcgccuucccccugaacagcuacaugaacgccaccaaccacgccaucguccagacccuggugcacuucaucaaccccgagaccgugcccaagccgugcugcgcgcccacgcagcucaacgccaucuccguccuguacuucgacgacagcuccaacgugauccugaagaaguaccgcaacauggugguccgggccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3940 - RNA, 647 nt, Artificial Sequence
  mRNA product Design3 comprising derived and/or modified sequence from Homo sapiens__NP_006264.2__HsCCL7 (opt1)
gggagagucccgcagucggcguccagcggcucugcuuguucgugugugugucguugcaggccuuauucaagcuuaccaugaaggccagcgccgcgcugcucugccugcugcucaccgccgccgccuucagcccccagggccuggcccagccgguggggaucaacaccuccacgaccugcugcuaccgcuucaucaacaagaagauccccaagcagcggcuggaguccuaccgccggaccaccagcucccacugcccccgcgaggcggucaucuucaagacgaagcucgacaaggagaucugcgccgaccccacccagaagugggugcaggacuucaugaagcaccuggacaagaagacccagaccccgaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3941 - RNA, 3971 nt, Artificial Sequence
  mRNA product Design3 comprising derived and/or modified sequence from Homo sapiens__NP_001954.2__HsEGF (opt1)
gggagagucccgcagucggcguccagcggcucugcuuguucgugugugugucguugcaggccuuauucaagcuuaccaugcugcucacccugaucauccugcuccccguggucagcaaguucuccuucgugagccuguccgcgccccagcacuggagcugccccgagggcacccuggccgggaacggcaacuccacgugcguggggcccgcccccuuccucaucuucagccacggcaacuccaucuuccgcaucgacaccgaggggaccaacuacgagcagcuggucguggacgccggcgugagcgucaucauggacuuccacuacaacgagaagcggaucuacuggguggaccuggagcgccagcuccugcagcggguguuccugaacggcucccgccaggagcgggucugcaacaucgagaagaacgugagcgggauggccaucaacuggaucaacgaggaggugaucugguccaaccagcaggagggcaucaucaccgucacggacaugaaggggaacaacagccacauccuccuguccgcccugaaguacccggccaacguggcgguggaccccgucgagcgcuucaucuucuggagcuccgagguggccggcagccucuaccgggccgaccuggacggggugggcgucaaggcccugcucgagaccuccgagaagaucaccgcggugagccuggacgugcuggacaagcgccucuucuggauccaguacaaccgggagggcuccaacagccugaucugcagcugcgacuacgacgggggcuccguccacaucagcaagcaccccacccagcacaaccuguucgccaugucccucuucggggaccgcaucuucuacagcacguggaagaugaagaccaucuggaucgccaacaagcacaccggcaaggacauggugcggaucaaccugcacuccagcuucgugccccugggcgagcucaaggucgugcacccgcuggcccagcccaaggccgaggacgacaccugggagcccgagcagaagcugugcaagcuccgcaaggggaacugcuccagcacggucugcggccaggaccugcagucccaccugugcaugugcgcggagggguacgcccucagccgggaccgcaaguacugcgaggacgugaacgagugcgccuucuggaaccacggcugcacccuggggugcaagaacacccccggcuccuacuacugcacgugcccggugggcuucguccugcuccccgacgggaagcggugccaccagcuggugagcugcccccgcaacguguccgagugcagccacgacugcguccugaccuccgagggcccccucugcuucugcccggaggggagcgugcuggagcgggacggcaagaccugcuccgggugcagcucccccgacaacggcggcugcagccagcugugcgugccccucagccccgucuccugggagugcgacugcuucccgggguacgaccugcagcuggacgagaaguccugcgccgccagcggcccccagcccuuccuccuguucgcgaacagccaggacauccgccacaugcacuucgacgggaccgacuacggcacccugcucucccagcagauggggaugguguacgcccuggaccacgaccccguggagaacaagaucuacuucgcccacacggcccugaaguggaucgagcgggccaacauggacggcagccagcgcgagcggcugaucgaggagggcgucgacgugccggaggggcucgcgguggacuggaucggccgccgcuucuacuggaccgaccgggggaagucccugaucggccgcagcgaccugaacggcaagcgguccaagaucaucaccaaggagaacaucagccagccccgcgggaucgccguccaccccauggccaagcgccucuucuggaccgacacgggcaucaacccccggaucgaguccagcucccugcaggggcugggccggcucgugaucgccagcuccgaccugaucuggccgagcgggaucaccaucgacuuccugaccgacaagcucuacuggugcgacgccaagcaguccgugaucgagauggcgaaccuggacggcagcaagcgccggcgccugacccagaacgacgucggccaccccuucgccguggccguguucgaggacuacgucugguucagcgacugggccaugcccuccgugaugcgggugaacaagcgcacggggaaggaccggguccgccuccagggcagcaugcugaagccguccagccugguggugguccacccccucgcgaagcccggggccgaccccugccuguaccagaacggcgggugcgagcacaucugcaagaagcggcugggcaccgccuggugcuccugccgcgagggcuucaugaaggccagcgacgggaagaccugccucgcccuggacggccaccagcugcucgccgggggcgagguggaccugaagaaccaggugaccccgcuggacauccucuccaagacgcgggucagcgaggacaacaucaccgagucccagcacaugcugguggccgagaucauggugagcgaccaggacgacugcgcccccgucgggugcuccauguacgcccgcugcaucagcgagggcgaggacgcgaccugccagugccugaagggcuucgcgggggacggcaagcucugcuccgacaucgacgagugcgagaugggggugcccgugugcccgccggccagcuccaagugcaucaacaccgagggcggguacgucugccggugcagcgagggcuaccagggcgacgggauccacugccuggacaucgacgagugccagcugggcgagcacuccugcggggagaacgccagcugcacgaacaccgagggcggcuacacgugcaugugcgccgggcgccucuccgagcccggccugaucugccccgacagcacgcccccgccccaccuccgcgaggacgaccaccacuacagcgugcggaacuccgacagcgagugcccccugucccacgacggguacugccugcacgacggcgugugcauguacaucgaggcccuggacaaguacgcgugcaacugcgucgugggguacaucggcgagcgcugccaguaccgggaccucaaguggugggagcugcgccacgccggccacgggcagcagcagaaggugaucgucguggccgugugcgucguggugcuggucaugcuccugcugcucagccuguggggcgcccacuacuaccggacccagaagcugcucuccaagaaccccaagaacccguacgaggagagcucccgcgacgugcggagccgccggcccgcggacaccgaggacgggauguccagcugcccccagcccugguucguggucaucaaggagcaccaggaccugaagaacggcgggcagccgguggccggcgaggacggccaggccgccgacggguccaugcagcccaccagcuggcgccaggagccccagcugugcggcauggggaccgagcagggcugcuggauccccgucuccagcgacaagggguccugcccccaggugauggagcggagcuuccacaugcccuccuacggcacccagacccucgagggcgggguggagaagccccacagccugcuguccgccaacccgcucuggcagcagcgcgcgcuggacccgccccaccagauggagcugacccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3942 - RNA, 857 nt, Artificial Sequence
  mRNA product Design3 comprising derived and/or modified sequence from Homo sapiens__NP_001423.1__HsEREG (opt1)
gggagagucccgcagucggcguccagcggcucugcuuguucgugugugugucguugcaggccuuauucaagcuuaccaugaccgccggccgccggauggagaugcugugcgccgggcgcgugcccgcgcuccugcugugccucggcuuccaccuccugcaggccguccugagcaccacggugaucccguccugcauccccggggagagcuccgacaacugcaccgcccuggugcagaccgaggacaacccccgggucgcccaggugagcaucaccaagugcuccagcgacaugaacggcuacugccugcacgggcagugcaucuaccucguggacaugucccagaacuacugccgcugcgaggucggcuacacgggcgugcggugcgagcacuucuuccugaccgugcaccagccccugagcaaggaguacgucgcccucaccgugauccugaucauccuguuccucaucaccguggucggguccacguacuacuucugccgcugguaccggaaccgcaagagcaaggagccgaagaaggaguacgagcgggugaccuccggcgaccccgagcugccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3943 - RNA, 815 nt, Artificial Sequence
  mRNA product Design3 comprising derived and/or modified sequence from Homo sapiens__NP_000791.1__HsFGF1 (opt1)
gggagagucccgcagucggcguccagcggcucugcuuguucgugugugugucguugcaggccuuauucaagcuuaccauggccgagggcgagaucaccaccuucacggcccugaccgagaaguucaaccugcccccggggaacuacaagaagcccaagcuccuguacugcagcaacggcgggcacuuccuccgcauccugcccgacggcaccguggacgggacccgggaccgcuccgaccagcacauccagcugcagcucagcgcggaguccgucggcgagguguacaucaagagcacggagaccggccaguaccuggccauggacaccgacgggcugcucuacggcucccagacccccaacgaggagugccuguuccuggagcggcucgaggagaaccacuacaacacguacaucagcaagaagcacgccgagaagaacugguucguggggcugaagaagaacggcuccugcaagcgcgggccgcggacccacuacggccagaaggccauccuguuccucccccugcccgucagcuccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3944 - RNA, 1214 nt, Artificial Sequence
  mRNA product Design3 comprising derived and/or modified sequence from Homo sapiens__NP_001997.5__HsFGF2 (opt1)
gggagagucccgcagucggcguccagcggcucugcuuguucgugugugugucguugcaggccuuauucaagcuuaccauggugggcgucgggggcggggacguggaggacgugaccccgcgcccgggcgggugccagaucagcggccggggcgcccgcgggugcaacggcauccccggggccgcggccugggaggccgcccugccccggcgccggccccgccggcacccguccgucaacccccgcagccgggccgcgggcagcccccgcacccgggggcgccggacggaggagcgccccuccggcucccggcucggcgaccgcgggcggggccgcgcccugcccgggggccggcugggcgggcgcggccgggggcgcgcccccgagcgcgugggcgggcggggccgcggccgggggaccgccgcgccccgcgccgcccccgccgcccggggcagccgcccggggcccgcgggcaccauggccgccggguccaucaccacgcuccccgcccugcccgaggacggcggcagcggggccuucccgcccggccacuucaaggaccccaagcggcuguacugcaagaacgggggcuucuuccuccgcauccaccccgacgggcggguggacggcguccgcgagaaguccgacccgcacaucaagcugcagcugcaggcggaggagcggggcguggugagcaucaagggggucugcgccaaccgcuaccucgccaugaaggaggacggccggcugcuggccuccaagugcgugaccgacgagugcuucuucuucgagcgccucgagagcaacaacuacaacaccuaccggucccgcaaguacaccagcugguacguggcccugaagcggacggggcaguacaagcugggcuccaagaccggccccgggcagaaggcgauccucuuccugcccaugagcgccaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3945 - RNA, 932 nt, Artificial Sequence
  mRNA product Design3 comprising derived and/or modified sequence from Homo sapiens__NP_002000.1__HsFGF7 (opt1)
gggagagucccgcagucggcguccagcggcucugcuuguucgugugugugucguugcaggccuuauucaagcuuaccaugcacaaguggauccugaccuggauccuccccacccugcuguaccgcagcugcuuccacaucaucugccucgugggcacgaucucccuggccugcaacgacaugaccccggagcagauggccaccaacgucaacugcagcucccccgagcggcacacccgcagcuacgacuacauggagggcggggacauccgggugcgccggcuguucugccgcacgcagugguaccuccggaucgacaagcgcgggaaggugaagggcacccaggagaugaagaacaacuacaacaucauggagauccggaccgucgcgguggggaucguggccaucaagggcgucgaguccgaguucuaccuggccaugaacaaggagggcaagcuguacgccaagaaggagugcaacgaggacugcaacuucaaggagcucauccuggagaaccacuacaacaccuacgccagcgcgaaguggacgcacaacgggggcgagauguucguggcccugaaccagaaggggauccccgugcgcggcaagaagaccaagaaggagcagaagaccgcccacuuccuccccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3946 - RNA, 974 nt, Artificial Sequence
  mRNA product Design3 comprising derived and/or modified sequence from Homo sapiens__NP_001936.1__HsHBEGF (opt1)
gggagagucccgcagucggcguccagcggcucugcuuguucgugugugugucguugcaggccuuauucaagcuuaccaugaagcugcuccccagcgugguccugaagcuguuccucgccgccgugcuguccgcgcuggugaccggcgagagccucgagcggcugcggcgcgggcuggccgccggcaccuccaacccggacccgcccacggucagcaccgaccagcuccugccccucgggggcgggcgggaccgcaaggugcgggaccugcaggaggccgaccuggaccugcuccgcgugacccuguccagcaagccccaggcccuggcgacccccaacaaggaggagcacggcaagcggaagaagaagggcaaggggcucggcaagaagcgcgaccccugccugcggaaguacaaggacuucugcauccacggggagugcaaguacgucaaggagcugcgcgcccccuccugcaucugccacccgggcuaccacggggagcggugccacggccucagccugcccguggagaaccgccuguacacguacgaccacaccaccauccucgccguggucgccguggugcuguccagcgucugccugcucgugaucgugggccugcugauguuccgguaccaccgccgcgggggcuacgacgucgagaacgaggagaaggugaagcucgggaugaccaacucccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3947 - RNA, 2534 nt, Artificial Sequence
  mRNA product Design3 comprising derived and/or modified sequence from Homo sapiens__NP_000592.3__HsHGF (opt1)
gggagagucccgcagucggcguccagcggcucugcuuguucgugugugugucguugcaggccuuauucaagcuuaccaugugggugaccaagcugcuccccgcccugcugcuccagcacguccugcugcaccuccugcugcucccgaucgccauccccuacgcggagggccagcgcaagcggcgcaacaccauccacgaguucaagaaguccgccaagacgacccugaucaagaucgaccccgcccugaagaucaagaccaagaaggugaacaccgccgaccagugcgccaaccggugcacgcgcaacaaggggcuccccuucacgugcaaggcguucguguucgacaaggcccggaagcagugccugugguucccguucaacagcaugagcuccggcgucaagaaggaguucgggcacgaguucgaccuguacgagaacaaggacuacauccgcaacugcaucaucggcaaggggcggagcuacaagggcaccguguccaucaccaagagcggcaucaagugccagcccugguccagcaugaucccccacgagcacuccuuccuccccagcuccuaccgcgggaaggaccugcaggagaacuacugccggaacccgcgcggcgaggagggcgggcccuggugcuucaccagcaaccccgaggugcgguacgaggucugcgacaucccccagugcuccgagguggagugcaugaccugcaacggggagagcuaccgcggccugauggaccacaccgaguccggcaagaucugccagcggugggaccaccagaccccgcaccgccacaaguuccuccccgagcgguaccccgacaagggguucgacgacaacuacugccgcaaccccgacggccagccgcggcccuggugcuacacgcuggacccccacacccgcugggaguacugcgccaucaagaccugcgccgacaacaccaugaacgacacggacgugccccuggagaccaccgagugcauccaggggcagggcgagggcuaccgggggaccgucaacacgaucuggaacggcaucccgugccagcgcugggacagccaguacccccacgagcacgacaugacccccgagaacuucaagugcaaggaccuccgggagaacuacugccgcaaccccgacggguccgagagcccguggugcuucaccaccgaccccaacauccgcgugggcuacugcucccagauccccaacugcgacaugagccacgggcaggacugcuaccggggcaacggcaagaacuacauggggaaccugagccagacgcgcuccggccugaccugcagcaugugggacaagaacauggaggaccuccaccggcacaucuucugggagcccgacgcguccaagcugaacgagaacuacugccgcaacccggacgacgacgcccacgggcccuggugcuacaccggcaacccccugaucccgugggacuacugccccaucagccggugcgagggggacaccacgcccaccaucgugaaccucgaccaccccgucaucuccugcgccaagaccaagcagcugcgcguggugaacggcaucccgacccggacgaacaucggcuggauggucagccugcgcuaccggaacaagcacaucugcgggggcucccucaucaaggagagcugggugcugaccgcccgccagugcuuccccucccgggaccugaaggacuacgaggccuggcucgggauccacgacgugcacggccgcggggacgagaagugcaagcagguccugaacgugagccagcugguguacggccccgagggcuccgaccucguccugaugaagcuggcgcggcccgccgugcucgacgacuucgugagcaccaucgaccugccgaacuacgggugcaccauccccgagaagacguccugcagcgucuacggcuggggguacaccggccugaucaacuacgacggccuccugcgcguggcccaccuguacaucauggggaacgagaagugcucccagcaccaccggggcaaggucacccucaacgagagcgagaucugcgccggggccgagaagaucggcuccgggcccugcgagggcgacuacggcgggccccuggugugcgagcagcacaagaugcgcauggugcugggcgucaucgugccggggcggggcugcgcgauccccaaccgccccgggaucuucgugcgggucgccuacuacgccaaguggauccacaagaucauccucaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3948 - RNA, 2273 nt, Artificial Sequence
  mRNA product Design3 comprising derived and/or modified sequence from Homo sapiens__NP_005336.3 __HsHSPA1A (opt1)
gggagagucccgcagucggcguccagcggcucugcuuguucgugugugugucguugcaggccuuauucaagcuuaccauggccaaggccgcggccaucggcaucgaccuggggaccaccuacagcugcgugggcguguuccagcacgggaagguggagaucaucgccaacgaccagggcaaccgcacgacccccuccuacguggccuucaccgacaccgagcggcucaucggggacgccgcgaagaaccaggucgcccugaacccgcagaacacgguguucgacgccaagcgccugaucggccggaaguucggcgaccccgugguccagagcgacaugaagcacuggcccuuccaggugaucaacgacggggacaagcccaaggugcaggucuccuacaagggcgagaccaaggccuucuacccggaggagaucagcuccauggugcucaccaagaugaaggagaucgcggaggccuaccugggguaccccgugaccaacgccgucaucacggugcccgccuacuucaacgacagccagcgccaggccaccaaggacgcgggcgugaucgccgggcugaacguccuccggaucaucaacgagcccaccgccgccgccaucgcguacggccuggaccgcaccggcaagggggagcggaacgugcugaucuucgaccucggcgggggcacguucgacguguccauccugaccaucgacgacggcaucuucgaggucaaggccaccgccggggacacccaccugggcggggaggacuucgacaaccgccucgugaaccacuucguggaggaguucaagcggaagcacaagaaggacaucagccagaacaagcgcgccguccggcgccugcggacggccugcgagcgcgcgaagcggacccuguccagcuccacccaggccagccucgagaucgacucccuguucgagggcaucgacuucuacaccagcaucacgcgcgcccgguucgaggagcugugcuccgaccucuuccgcagcacccuggagccgguggagaaggcccugcgggacgccaagcucgacaaggcgcagauccacgaccuggugcuggucgggggcuccacccgcauccccaaggugcagaagcuccugcaggacuucuucaacggccgggaccugaacaagagcaucaaccccgacgaggccgucgccuacggggccgcggugcaggccgccauccucaugggcgacaaguccgagaacgugcaggaccugcugcuccuggacgucgcgccccugagccucgggcuggagaccgccggcggggugaugacggcccugaucaagcgcaacagcaccaucccgaccaagcagacccagaucuucacgaccuacuccgacaaccagcccggcgugcucauccaggucuacgagggcgagcgcgccaugaccaaggacaacaaccugcuggggcgguucgagcucagcggcaucccgcccgcgccccgcggggugccccagaucgaggugaccuucgacaucgacgccaacggcauccugaacgucacggccaccgacaaguccaccgggaaggccaacaagaucaccaucacgaacgacaagggccggcugagcaaggaggagaucgagcgcauggugcaggaggccgagaaguacaaggccgaggacgaggugcagcgggagcgcgucuccgccaagaacgcccucgagagcuacgcguucaacaugaaguccgccguggaggacgagggccugaaggggaagaucagcgaggccgacaagaagaaggugcuggacaagugccaggaggucaucuccuggcucgacgccaacacccuggcggagaaggacgaguucgagcacaagcggaaggagcuggagcaggucugcaaccccaucaucagcggccucuaccagggggccggcggccccgggccgggcggguucggcgcccaggggcccaagggcggcuccgggagcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3949 - RNA, 2273 nt, Artificial Sequence; identical to SEQ ID NO: 3948
  mRNA product Design3 comprising derived and/or modified sequence from Homo sapiens__NP_005337.2 __HsHSPA1B (opt1)

SEQ ID NO: 3950 - RNA, 2273 nt, Artificial Sequence
  mRNA product Design3 comprising derived and/or modified sequence from Homo sapiens__NP_005518.3 __HsHSPA1L (opt1)
gggagagucccgcagucggcguccagcggcucugcuuguucgugugugugucguugcaggccuuauucaagcuuaccauggccaccgccaagggcaucgcgaucgggaucgaccugggcaccacguacagcugcgugggggucuuccagcacggcaagguggagaucaucgccaacgaccaggggaaccgcaccacccccuccuacguggccuucaccgacacggagcggcucaucggcgacgccgccaagaaccaggucgcgaugaacccgcagaacaccguguucgacgccaagcgccugaucggccggaaguucaacgaccccgugguccaggccgacaugaagcuguggcccuuccaggugaucaacgagggcgggaagcccaaggugcucgucagcuacaagggggagaacaaggccuucuacccggaggagaucuccagcauggugcugaccaagcugaaggagaccgcggaggccuuccucggccaccccgugacgaacgccgucaucaccgugcccgccuacuucaacgacucccagcgccaggccaccaaggacgcgggggugaucgccggccugaacguccugcggaucaucaacgagcccaccgccgccgccaucgcguacggccucgacaagggcgggcagggggagcgccacgugcugaucuucgaccugggcggcgggacguucgacgugagcauccucaccaucgacgacggcaucuucgaggucaaggccaccgccggggacacccaccugggcggggaggacuucgacaaccggcuggugucccacuucguggaggaguucaagcgcaagcacaagaaggacaucagccagaacaagcgggccguccgccggcuccgcacggccugcgagcgggcgaagcgcacccuguccagcuccacccaggccaaccuggagaucgacagccucuacgagggcaucgacuucuacaccuccaucacgcgggcccgcuucgaggagcugugcgccgaccuguuccggggcacccucgagccgguggagaaggcccugcgcgacgcgaagauggacaaggccaagauccacgacaucgugcuggucgggggcagcacccggauccccaaggugcagcgccuccugcaggacuacuucaacgggcgggaccugaacaaguccaucaaccccgacgaggccgucgccuacggcgcggccgugcaggccgccauccucaugggggacaagagcgagaaggugcaggaccugcugcuccuggacgucgcgccccugucccucggccuggagaccgccggcggggugaugacggcccugaucaagcgcaacagcaccaucccgaccaagcagacccagaucuucacgaccuacuccgacaaccagcccggcgugcucauccaggucuacgagggggagcgcgccaugaccaaggacaacaaccugcugggccgguucgaccucaccgggaucccgcccgcgccccgcggcgugccccagaucgaggugacguucgacaucgacgccaacggcauccugaacgucaccgccaccgacaagagcaccgggaaggugaacaagaucacgaucaccaacgacaagggccggcugagcaaggaggagaucgagcgcauggugcucgacgccgagaaguacaaggccgaggacgagguccagcgggagaagaucgccgccaagaacgcgcuggaguccuacgccuucaacaugaaguccguggugagcgacgaggggcugaagggcaagaucagcgaguccgacaagaacaagauccucgacaagugcaacgagcugcugagcuggcucgaggucaaccagcuggccgagaaggacgaguucgaccacaagcgcaaggagcuggagcagaugugcaaccccaucaucaccaagcuguaccagggcgggugcaccggccccgccugcgggaccggcuacgugccggggcggcccgcgacgggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3951 - RNA, 2267 nt, Artificial Sequence
  mRNA product Design3 comprising derived and/or modified sequence from Homo sapiens__NP_068814.2 __HsHSPA2 (opt1)
gggagagucccgcagucggcguccagcggcucugcuuguucgugugugugucguugcaggccuuauucaagcuuaccaugagcgcccgcggccccgccaucgggaucgaccugggcaccaccuacuccugcgugggggucuuccagcacggcaagguggagaucaucgcgaacgaccaggggaaccggacgaccccgagcuacguggccuucaccgacaccgagcgccucaucggcgacgccgccaagaaccaggucgccaugaaccccacgaacaccaucuucgacgcgaagcggcugaucggccgcaaguucgaggacgccaccgugcaguccgacaugaagcacuggcccuuccggguggucagcgagggcgggaagcccaagguccagguggaguacaagggggagaccaagacguucuucccggaggagaucuccagcauggugcugaccaagaugaaggagaucgccgaggccuaccucggcgggaaggugcacuccgcggugaucaccguccccgccuacuucaacgacagccagcgccaggccaccaaggacgccggcacgaucaccggccugaacgugcugcggaucaucaacgagcccaccgccgcggccaucgccuacgggcucgacaagaagggcugcgccgggggcgagaagaacgugcugaucuucgaccugggcgggggcaccuucgacgucuccauccucacgaucgaggacgggaucuucgaggucaagagcaccgccggcgacacccaccucgggggcgaggacuucgacaaccgcauggugucccaccuggcggaggaguucaagcggaagcacaagaaggacaucggccccaacaagcgcgccgugcggcgccugcggaccgccugcgagcgcgccaagcggacgcugagcuccagcacccaggccuccaucgagaucgacagccuguacgaggggguggacuucuacaccuccaucacccgcgcgcgguucgaggagcucaacgccgaccuguuccgcggcacgcuggagccgguggagaaggcccuccgggacgccaagcuggacaaggggcagauccaggagaucguccuggugggcgggagcacccgcauccccaagauccagaagcuccugcaggacuucuucaacggcaaggagcugaacaaguccaucaaccccgacgaggccguggcguacggcgccgccguccaggccgcgauccucaucggggacaagagcgagaacgugcaggaccugcugcuccuggacgucacgccccugagccucggcaucgagaccgccgggggcgugaugaccccgcugaucaagcggaacaccaccauccccaccaagcagacgcagaccuucaccaccuacuccgacaaccagagcuccgugcugguccagguguacgagggggagcgcgccaugacgaaggacaacaaccuccugggcaaguucgaccugaccggcaucccgcccgcgccccgcggggugccccagaucgaggucaccuucgacaucgacgccaacggcauccucaacgugaccgccgccgacaagagcaccgggaaggagaacaagaucacgaucaccaacgacaagggccggcuguccaaggacgacaucgaccgcauggugcaggaggccgagcgguacaagagcgaggacgaggccaaccgcgaccgggucgccgcgaagaacgcccuggaguccuacaccuacaacaucaagcagaccguggaggacgagaagcuccgcggcaagaucagcgagcaggacaagaacaagauccuggacaagugccaggaggugaucaacuggcuggaccggaaccagauggccgagaaggacgaguacgagcacaagcagaaggagcucgagcgcgucugcaaccccaucaucuccaagcuguaccagggcgggcccgggggcgggagcggcggcgggggcuccggggccagcggcgggccgacgaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3952 - RNA, 2870 nt, Artificial Sequence
  mRNA product Design3 comprising derived and/or modified sequence from Homo sapiens__NP_002145.3 __HsHSPA4 (opt1)
gggagagucccgcagucggcguccagcggcucugcuuguucgugugugugucguugcaggccuuauucaagcuuaccaugagcguggucggcaucgaccugggguuccaguccugcuacguggccguggcccgcgcgggcgggaucgagaccaucgccaacgaguacagcgaccggugcacccccgccugcaucuccuucggcccgaagaaccgcagcaucggggccgccgcgaagucccaggucaucagcaacgccaagaacacggugcagggcuucaagcgguuccacggccgcgccuucuccgaccccuucguggaggccgagaaguccaaccucgcguacgacaucguccagcugcccaccgggcugaccggcaucaaggugaccuacauggaggaggagcggaacuucacgaccgagcaggucaccgccaugcuccugagcaagcugaaggagaccgccgagagcgugcucaagaagcccgugguggacugcgucguguccgugccgugcuucuacacggacgccgagcgccggagcgucauggacgccacccagaucgcggggcugaacugccugcgccucaugaacgagaccaccgccguggcccuggccuacggcaucuacaagcaggaccugcccgcccucgaggagaagccccggaacguggucuucguggacauggggcacuccgcguaccaggugagcgucugcgccuucaaccgcggcaagcugaaggugcuggccacggccuucgacaccacccucggcgggcggaaguucgacgaggugcuggucaaccacuucugcgaggaguucggcaagaaguacaagcuggacaucaaguccaagauccgcgcccuccugcggcugagccaggagugcgagaagcucaagaagcugauguccgcgaacgccagcgaccugccccucuccaucgagugcuucaugaacgacguggacgucagcgggaccaugaaccgcggcaaguuccuggagaugugcaacgaccugcucgcccggguggagccgccccugcgcagcgugcuggagcagacgaagcucaagaaggaggacaucuacgccgucgagaucgugggcggggccacccggauccccgcggugaaggagaagaucuccaaguucuucggcaaggagcugagcaccacccugaacgccgacgaggccgucacgcgcgggugcgcccuccagugcgcgauccugucccccgccuucaaggugcgggaguucagcaucaccgacguggucccguaccccaucucccugcgcuggaacagccccgccgaggagggcuccagcgacugcgagguguucuccaagaaccacgccgcccccuucagcaaggugcucaccuucuaccggaaggagccguucacccuggaggcguacuacuccagcccccaggaccugcccuaccccgacccggccaucgcccaguucuccguccagaaggugacgccccagagcgacggguccagcuccaaggugaaggucaaggugcgcgugaacguccacggcaucuucagcguguccagcgccagccucguggagguccacaaguccgaggagaacgaggagcccauggagaccgaccagaacgccaaggaggaggagaagaugcaggucgaccaggaggagccccacguggaggagcagcagcagcagaccccggcggagaacaaggccgagagcgaggagauggagaccucccaggccggcagcaaggacaagaagauggaccagccgccccaggccaagaaggccaaggugaagacguccaccguggaccugcccaucgagaaccagcugcucuggcagaucgaccgcgagaugcugaaccuguacaucgagaacgaggggaagaugaucaugcaggacaagcucgagaaggagcggaacgacgcgaagaacgccguggaggaguacgucuacgagaugcgcgacaagcugagcggcgaguacgagaaguucguguccgaggacgaccggaacagcuucacccugaagcucgaggacaccgagaacuggcuguacgaggacggggaggaccagcccaagcaggucuacguggacaagcuggccgagcugaagaaccucggccagcccaucaagauccgcuuccaggaguccgaggagcggcccaagcuguucgaggagcuggggaagcagauccagcaguacaugaagaucaucagcuccuucaagaacaaggaggaccaguacgaccaccucgacgccgcggacaugacgaagguggagaaguccaccaacgaggccauggaguggaugaacaacaagcugaaccugcagaacaagcagagccucaccauggacccgguggucaagagcaaggagaucgaggccaagaucaaggagcugaccuccacgugcagccccaucaucuccaagcccaagcccaagguggagccgcccaaggaggagcagaagaacgccgagcagaacggccccguggacggccagggggacaaccccggcccgcaggccgcggagcaggggaccgacaccgccguccccagcgacagcgacaagaagcugcccgagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3953 - RNA, 2867 nt, Artificial Sequence
  mRNA product Design3 comprising derived and/or modified sequence from Homo sapiens__NP_055093.2 __HsHSPA4L (opt1)
gggagagucccgcagucggcguccagcggcucugcuuguucgugugugugucguugcaggccuuauucaagcuuaccaugagcguggucggcaucgaccugggguuccucaacugcuacaucgccguggcccgcuccggcgggaucgagaccaucgcgaacgaguacagcgaccggugcacccccgccugcaucucccugggcagccgcacgcgggccaucgggaacgccgccaagucccagaucgugaccaacguccgcaacaccauccacggcuucaagaagcugcacggccggagcuucgacgacccgaucgugcagaccgagcgcauccggcuccccuacgagcugcagaagaugcccaacggguccgcgggcgugaagguccgcuaccuggaggaggagcggcccuucgccaucgagcaggucacggggaugcuccuggccaagcugaaggagaccagcgagaacgcccucaagaagccgguggcggacugcgugaucuccauccccagcuucuucaccgacgccgagcgccgguccgugauggccgccgcccagguggcgggccugaacugccugcgccucaugaacgagaccacggccgucgcccuggccuacgggaucuacaagcaggaccugccgccccucgacgagaagccccggaacgugguguucaucgacaugggccacagcgccuaccagguccuggugugcgcguucaacaagggcaagcugaaggugcucgccaccaccuucgaccccuaccucgggggccgcaacuucgacgaggcccuggucgacuacuucugcgacgaguucaagaccaaguacaagaucaacgugaaggagaacucccgggcccugcugcgccuguaccaggagugcgagaagcucaagaagcugaugagcgccaacgcguccgaccugccccucaacaucgagugcuucaugaacgaccuggacgugagcuccaagaugaaccgggcccaguucgagcagcugugcgccagccuccuggcccgcgucgagcccccgcugaaggccgugauggagcaggcgaaccuccagcgggaggacaucuccagcaucgagaucgucgggggcgccacgcgcauccccgccgugaaggagcagaucaccaaguucuuccugaaggacaucagcaccacccugaacgccgacgaggcgguggcccggggcugcgcccuccagugcgccauccugucccccgccuucaagguccgcgaguucagcaucacggaccuggugcccuacuccaucacccuccgcuggaagaccagcuucgaggacggguccggcgagugcgagguguucugcaagaaccacccggcgcccuucagcaaggucaucaccuuccacaagaaggagcccuucgagcuggaggccuucuacacgaaccugcacgaggugcccuacccggacgcccggaucggguccuucaccauccagaacguguucccccagagcgacggcgacuccagcaaggucaaggugaaggugcgcgucaacauccacgggaucuucuccguggccagcgccuccgugaucgagaagcagaaccucgagggcgaccacagcgacgcgcccauggagaccgagaccuccuucaagaacgagaacaaggacaacauggacaagaugcaggucgaccaggaggagggccaccagaagugccacgccgagcacacgcccgaggaggagaucgaccacaccggggccaagaccaagagcgccguguccgacaagcaggaccggcugaaccagacccugaagaagggcaaggucaagagcaucgaccucccgauccaguccagccugugccgccagcuggggcaggaccuccugaacagcuacaucgagaacgagggcaagaugaucaugcaggacaagcuggagaaggagcggaacgacgccaagaacgcgguggaggaguacguguacgacuuccgcgaccggcuggggacgguguacgagaaguucaucacccccgaggaccucuccaagcugagcgccguccuggaggacaccgagaacuggcucuacgaggacggcgaggaccagcccaagcaggucuacguggacaagcugcaggagcugaagaaguacggccagcccauccagaugaaguacauggagcacgaggagcgcccgaaggcccucaacgaccuggggaagaagauccagcuggugaugaaggugaucgaggccuaccggaacaaggacgagcgcuacgaccaccucgaccccaccgagauggagaagguggagaagugcaucuccgacgcgaugagcuggcugaacuccaagaugaacgcccagaacaagcugagccucacgcaggaccccgucgugaagguguccgagaucgucgccaagagcaaggagcuggacaacuucugcaacccgaucaucuacaagcccaagcccaaggccgaggugcccgaggacaagccgaaggccaacuccgagcacaacggccccauggacgggcagagcggcaccgagaccaaguccgacagcaccaaggacuccagccagcacacgaaguccagcggggagauggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3954 - RNA, 2312 nt, Artificial Sequence
  mRNA product Design3 comprising derived and/or modified sequence from Homo sapiens__NP_005338.1__HsHSPA5 (opt1)
gggagagucccgcagucggcguccagcggcucugcuuguucgugugugugucguugcaggccuuauucaagcuuaccaugaagcugagccucguggccgccaugcugcugcuccuguccgcggcccgcgccgaggaggaggacaagaaggaggacgucggcaccgugguggggaucgaccugggcaccacguacagcugcgucgggguguucaagaacggccggguggagaucaucgccaacgaccaggggaaccgcaucacccccuccuacgucgccuucaccccggagggcgagcggcucaucggcgacgcggccaagaaccagcugaccagcaaccccgagaacacgguguucgacgccaagcgccugaucgggcggaccuggaacgaccccuccgugcagcaggacaucaaguuccuccccuucaaggucguggagaagaagaccaagccguacauccagguggacaucggcgggggccagaccaagacguucgcccccgaggagaucagcgcgaugguccugaccaagaugaaggagaccgccgaggccuaccuggggaagaaggugacccacgccguggucacggugcccgccuacuucaacgacgcgcagcgccaggccaccaaggacgccggcaccaucgccggccucaacgugaugcggaucaucaacgagcccaccgccgcggccaucgccuacgggcuggacaagcgcgagggcgagaagaacauccuggucuucgaccucgggggcggcacguucgacgugucccugcugaccaucgacaacgggguguucgaggucguggccaccaacggcgacacccaccucgggggcgaggacuucgaccagcgggugauggagcacuucaucaagcuguacaagaagaagacggggaaggacguccgcaaggacaaccgggccgugcagaagcugcgccgggaggucgagaaggcgaagcgcgcccucagcucccagcaccaggcccggaucgagaucgagagcuucuacgagggcgaggacuucuccgagacccugacccgcgccaaguucgaggagcugaacauggaccucuuccggagcaccaugaagccggugcagaaggugcuggaggacuccgaccugaagaaguccgacaucgacgagaucguccucgugggcgggagcacgcgcauccccaagauccagcagcuggugaaggaguucuucaacggcaaggagcccagccgggggaucaaccccgacgaggccgucgcguacggcgccgccgugcaggccggggugcuguccggcgaccaggacaccggcgaccucguccugcuggacgugugcccgcucacccuggggaucgagaccgugggcggggucaugacgaagcugaucccccgcaacaccguggugcccaccaagaagucccagaucuucagcaccgcgagcgacaaccagcccacggucaccaucaagguguacgagggcgagcggccgcucaccaaggacaaccaccuccuggggaccuucgaccugacgggcaucccgcccgcgccccgcggcgugccccagaucgaggucaccuucgagaucgacgugaacgggauccugcgcgugaccgccgaggacaagggcaccgggaacaagaacaagaucaccaucacgaacgaccagaaccggcugacccccgaggagaucgagcgcauggucaacgacgccgagaaguucgccgaggaggacaagaagcucaaggagcggaucgacacccgcaacgagcuggagagcuacgccuacucccugaagaaccagaucggcgacaaggagaagcucggcgggaagcugagcuccgaggacaaggagaccauggagaaggccguggaggagaagaucgaguggcuggagagccaccaggacgccgacaucgaggacuucaaggccaagaagaaggagcucgaggagaucgugcagcccaucaucuccaagcuguacggcagcgccgggcccccgcccacgggcgaggaggacaccgcggagaaggacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3955 - RNA, 2279 nt, Artificial Sequence
  mRNA product Design3 comprising derived and/or modified sequence from Homo sapiens__NP_002146.2__HsHSPA6 (opt1)
gggagagucccgcagucggcguccagcggcucugcuuguucgugugugugucguugcaggccuuauucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccgcguggugagcgagggcgggaagcccaagguccgggugugcuaccgcggcgaggacaagaccuucuacccggaggagaucuccagcauggugcuguccaagaugaaggagacggccgaggcguaccucgggcagcccgucaagcacgccgugaucaccgugcccgccuacuucaacgacagccagcggcaggccaccaaggacgccggcgcgaucgccgggcugaacguccugcgcaucaucaacgagcccaccgccgccgccaucgcguacggccucgaccggcgcggcgccggggagcggaacgugcugaucuucgaccugggcgggggcacguucgacguguccguccucagcaucgacgccggcguguucgaggugaaggccaccgccggggacacccaccugggcggggaggacuucgacaaccgccuggucaaccacuucauggaggaguuccggcgcaagcacggcaaggaccucuccgggaacaagcgggcgcugcgccggcugcgcaccgccugcgagcgggccaagcgcacgcucagcuccagcacccaggccacccuggagaucgacucccuguucgagggcguggacuucuacaccagcaucacgcgcgcccgguucgaggagcucugcuccgaccuguuccgcagcacccuggagccgguggagaaggcgcuccgggacgccaagcuggacaaggcccagauccacgacgucgugcuggucggcggguccacccgcauccccaaggugcagaagcuccugcaggacuucuucaacggcaaggagcugaacaagagcaucaaccccgacgaggccguggcguacggggccgccguccaggccgccgugcucaugggcgacaagugcgagaaggugcaggaccugcugcuccuggacgucgcgccccugagccucgggcuggagaccgccggcggcgugaugacgacccugauccagcggaacgccaccaucccgaccaagcagacgcagaccuucaccaccuacuccgacaaccagcccgggguguucauccaggucuacgagggcgagcgcgccaugacgaaggacaacaaccuccuggggcgguucgagcugagcggcaucccgcccgcgccccgcggggugccccagaucgaggugaccuucgacaucgacgccaacggcauccucuccgucaccgccaccgaccggagcacgggcaaggccaacaagaucaccaucaccaacgacaaggggcgccuguccaaggaggagguggagcggauggugcacgaggccgagcaguacaaggccgaggacgaggcgcagcgcgaccgggucgccgccaagaacagccuggaggcccacguguuccacgugaagggcucccuccaggaggagagccugcgcgacaagauccccgaggaggaccggcgcaagaugcaggacaagugccgggagguccuggcguggcucgagcacaaccagcuggccgagaaggaggaguacgagcaccagaagcgcgagcuggagcagaucugccggcccaucuucucccgccuguacgggggcccgggcgugcccgggggcagcuccugcgggacccaggcccgccagggcgaccccagcaccgggcccaucaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3956 - RNA, 1451 nt, Artificial Sequence
  mRNA product Design3 comprising derived and/or modified sequence from Homo sapiens__P48741__HsHSPA7 (opt1)
gggagagucccgcagucggcguccagcggcucugcuuguucgugugugugucguugcaggccuuauucaagcuuaccaugcaggcgccccgcgagcuggccgugggcaucgaccucgggaccaccuacagcugcgucggcguguuccagcaggggcggguggagauccuggccaacgaccagggcaaccgcacgaccccguccuacgucgccuucaccgacaccgagcggcuggugggggacgccgccaagagccaggccgcgcucaacccccacaacacgguguucgacgccaagcgccugaucggccggaaguucgccgacaccaccguccaguccgacaugaagcacuggcccuuccagguggugagcgagggcgggaagcccaagguccgcgugugcuaccggggcgaggacaagaccuucuacccggaggagaucuccagcauggugcuguccaagaugaaggagacggccgaggcguaccucgggcagcccgucaagcacgccgugaucaccgugcccaccuacuucagcaacucccagcgccaggccaccaaggacgccggcgccaucgcggggcugaagguccugcccaucaucaacgaggccacggccgccgccaucgcguacggccucgaccggcgcggcgccgggaagcggaacgugcugaucuucgaccugggcgggggcaccuucgacgugagcguccucuccaucgacgccggcguguucgaggugaaggccaccgccggggacacccaccugggcggggaggacuucgacaaccgccuggucaaccacuucauggaggaguuccggcgcaagcacggcaaggaccucagcgggaacaagcgggcgcugcgccggcugcgcacggccugcgagcgggccaagcgcaccccguccagcuccacccaggccacccucgagaucgacagccuguucgagggcguggacuucuacaaguccaucacgcgggcccgcuucgaggagcugugcagcgaccucuuccgcuccacccuggagcccguggagaaggcgcugcgggacgccaagcucgacaaggcccagauccacgacuucguccugggcgggggccugcacagccacccccagggggccgagguggcggccggccuccugcagcgccagggggccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3957 - RNA, 2288 nt, Artificial Sequence
  mRNA product Design3 comprising derived and/or modified sequence from Homo sapiens__NP_006588.1 __HsHSPA8 (opt1)
gggagagucccgcagucggcguccagcggcucugcuuguucgugugugugucguugcaggccuuauucaagcuuaccaugagcaagggccccgccguggggaucgaccugggcaccaccuacuccugcgucgggguguuccagcacggcaagguggagaucaucgccaacgaccaggggaaccgcacgacccccagcuacgucgcguucaccgacaccgagcggcucaucggcgacgccgccaagaaccagguggccaugaaccccacgaacaccguguucgacgccaagcgccugaucggccggcgcuucgacgacgcggucgugcaguccgacaugaagcacuggcccuucaugguggucaacgacgccgggcggcccaagguccagguggaguacaagggcgagaccaagagcuucuacccggaggagguguccagcauggugcugaccaagaugaaggagaucgccgaggccuaccucgggaagacggugaccaacgcggucgugaccgugcccgccuacuucaacgacucccagcgccaggccaccaaggacgccggcacgaucgccgggcugaacguccugcggaucaucaacgagcccaccgcggccgccaucgccuacggccucgacaagaaggugggcgccgagcgcaacgugcugaucuucgaccucgggggcgggaccuucgacgucagcauccugaccaucgaggacggcaucuucgaggugaaguccacggcgggcgacacccaccucgggggcgaggacuucgacaaccggauggugaaccacuucaucgccgaguucaagcgcaagcacaagaaggacaucagcgagaacaagcgggccguccgccggcugcgcaccgccugcgagcgggccaagcgcacccuguccagcuccacgcaggcgagcaucgagaucgacucccuguacgaggggaucgacuucuacaccagcaucacccgggcccgcuucgaggagcugaacgccgaccucuuccggggcacccuggaccccguggagaaggcccugcgcgacgccaagcucgacaagucccagauccacgacaucguccuggucgggggcagcacgcggaucccgaagauccagaagcugcuccaggacuucuucaacggcaaggagcugaacaaguccaucaaccccgacgaggcgguggccuacggggccgccgugcaggcggccauccugagcggcgacaagagcgagaacgugcaggaccuccugcugcucgacgugacgccccugucccuggggaucgagaccgccggcggggucaugaccgugcucaucaagcgcaacaccaccauccccaccaagcagacccagacguucaccaccuacagcgacaaccagccgggcgugcugauccaggucuacgagggcgagcgcgccaugaccaaggacaacaaccugcucgggaaguucgagcugacgggcaucccgcccgcgccccgcggggugccccagaucgaggugaccuucgacaucgacgccaacggcauccugaacgucuccgccguggacaagagcaccgggaaggagaacaagaucaccaucaccaacgacaagggccggcucuccaaggaggacaucgagcggauggugcaggaggccgagaaguacaaggccgaggacgagaagcagcgcgacaaggucagcuccaagaacagccuggaguccuacgccuucaacaugaaggcgacgguggaggacgagaagcugcagggcaagaucaacgacgaggacaagcagaagauccucgacaagugcaacgagaucaucaacuggcuggacaagaaccagaccgccgagaaggaggaguucgagcaccagcagaaggagcuggagaaggugugcaaccccaucaucaccaagcucuaccagagcgccgggggcaugcccgggggcaugcccggcggguucccgggcgggggcgccccgcccuccgggggcgccagcuccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3958 - RNA, 2387 nt, Artificial Sequence
  mRNA product Design3 comprising derived and/or modified sequence from Homo sapiens__NP_004125.3 __HsHSPA9 (opt1)
gggagagucccgcagucggcguccagcggcucugcuuguucgugugugugucguugcaggccuuauucaagcuuaccaugaucagcgccucccgcgccgcggccgcccggcuggugggcgccgccgcgagccgcgggcccaccgccgcccggcaccaggacuccuggaacggccucagccacgaggccuuccgccuggucucccggcgcgacuacgcgagcgaggccaucaagggggccguggugggcaucgaccuggggaccacgaacuccugcgucgccgugauggagggcaagcaggccaaggugcucgagaacgcggagggcgcccggaccaccccgagcgucguggccuucaccgccgacggggagcgccuggugggcaugcccgccaagcggcaggcggucacgaaccccaacaacaccuucuacgccaccaagcgccugaucgggcggcgcuacgacgaccccgaggugcagaaggacaucaagaacgugccguucaagaucguccgggccuccaacggcgacgccuggguggaggcccacgggaagcucuacagccccucccagaucggcgcguucgugcugaugaagaugaaggagaccgccgagaacuaccugggccacacggccaagaacgccgucaucaccgugcccgccuacuucaacgacagccagcgccaggcgaccaaggacgccgggcagaucuccggccucaacgugcugcgggucaucaacgagcccaccgccgccgcgcuggccuacgggcucgacaagagcgaggacaaggugaucgccguguacgaccugggcggcgggacguucgacaucuccauccuggagauccagaagggcgucuucgaggucaagagcaccaacggggacaccuuccucggcggggaggacuucgaccaggcccugcugcgccacaucgugaaggaguucaagcgggagaccggcguggaccucacgaaggacaacauggcccugcagcgcgugcgggaggcggccgagaaggccaagugcgagcuguccagcuccguccagaccgacaucaaccucccguaccugaccauggacagcagcggccccaagcaccugaacaugaagcucacccgcgcccaguucgaggggaucgugacggaccugauccggcgcaccaucgcccccugccagaaggcgaugcaggacgccgagguguccaagagcgacaucggcgaggucauccuggucgggggcaugacccgcaugcccaaggugcagcagaccgugcaggaccucuucgggcgggccccguccaaggccgugaaccccgacgaggccguggcgaucggcgccgccauccagggcgggguccuggccggcgacgugacggacgugcugcuccuggacgucacgccccugagccucgggaucgagacccugggcgggguguucaccaagcugaucaaccgcaacaccaccauccccaccaagaagucccagguguucagcaccgcggccgacggccagacgcaggucgagaucaaggugugccagggcgagcgggagauggccggggacaacaagcuccugggccaguucacccugaucgggaucccgcccgcgccccgcggcgugccccagaucgaggucaccuucgacaucgacgccaacggcaucgugcacguguccgccaaggacaaggggaccggccgggagcagcagaucgucauccagagcuccgggggccucagcaaggacgacaucgagaacauggugaagaacgccgagaaguacgccgaggaggaccgccggaagaaggagcgcguggaggccgucaacauggccgaggggaucauccacgacacggagaccaagauggaggaguucaaggaccagcugccggcggacgagugcaacaagcugaaggaggagaucuccaagaugcgggagcuccuggcccgcaaggacagcgagaccggcgagaacauccggcaggccgccuccagccugcagcaggccucccucaagcuguucgagauggcguacaagaagauggccagcgagcgcgagggcuccgggagcuccggcaccggggagcagaaggaggaccagaaggaggagaagcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3959 - RNA, 2375 nt, Artificial Sequence
  mRNA product Design3 comprising derived and/or modified sequence from Homo sapiens__NP_079291.2__HsHSPA12A (opt1)
gggagagucccgcagucggcguccagcggcucugcuuguucgugugugugucguugcaggccuuauucaagcuuaccauggccgacaaggaggccggcgggagcgacggcccccgcgagaccgcgccgaccuccgccuacagcucccccgcccggagccugggggacacgggcaucacgccccucucccccagccacaucgugaacgacaccgacuccaacgucagcgagcagcaguccuuccuggugguggucgccguggacuucgggaccaccagcuccggcuacgccuacagcuucaccaaggagccggagugcauccacgugaugcgccggugggagggcggggaccccggcgucuccaaccagaagacccccaccacgauccugcucacccccgagcgcaaguuccacagcuucggguacgcggcccgggacuucuaccacgaccuggacccgaacgaggccaagcaguggcuguaccucgagaaguucaagaugaagcugcacaccaccggcgaccugacgauggacaccgaccucaccgccgcgaacgggaagaaggugaaggcccuggagaucuucgccuacgcccugcaguacuucaaggagcaggcccucaaggagcuguccgaccaggcgggcagcgaguucgagaacuccgacgugcgcugggucaucaccgugcccgccaucuggaagcagcccgccaagcaguucaugcggcaggccgccuaccaggcgggccuggccagccccgagaacuccgagcagcucaucaucgcccuggagccggaggccgccagcaucuacugccgcaagcugcggcuccaccagaugaucgagcugagcuccaaggcggccgugaacggguacagcggcuccgacacggucggggccggcuucacccaggccaaggagcacauccgccggaaccgccagagccggaccuuccugguggagaacgugaucggcgagaucugguccgagcucgaggagggggacaaguacgucgugguggacagcggcgggggcaccgucgaccugacggugcaccagauccgccugcccgaggggcaccucaaggagcuguacaaggccaccggcggccccuacgggucccugggcguggacuacgaguucgagaagcuccuguacaagaucuucggggaggacuucaucgagcaguucaagaucaagcggcccgcggccugggucgaccugaugaucgccuucgagagccgcaagcgggccgcggccccggaccgcaccaacccccucaacaucacccugcccuucuccuucaucgacuacuacaagaaguuccggggccacagcguggagcacgcccugcgcaaguccaacguggacuucgucaaguggagcucccaggggaugcuccggaugagccccgacgccaugaacgcccuguucaagccgacgaucgacuccaucaucgagcaccuccgcgaccuguuccagaagcccgaggugagcaccgucaaguuccuguuccuggugggcggcuucgcggaggcgccccuccugcagcaggccgugcaggccgccuucggggaccagugccgcaucaucaucccccaggacgucggccugaccauccucaagggggccgugcuguucggccuggacccggccgugaucaagguccggcgcagcccccucaccuacggggugggcgugcugaaccgguacgucgagggcaagcacccgcccgagaagcugcucgugaaggacgggacgcgcuggugcaccgacguguucgacaaguucaucuccgccgaccaguccgucgcccugggcgagcuggugaagcggagcuacacccccgccaagcccagccagcuggugaucgucaucaacaucuacuccagcgagcacgacaacguguccuucaucaccgaccccggggugaagaagugcggcacgcuccgccuggaccugaccggcaccagcgggaccgcggucccggcccggcgcgagauccagacgcucaugcaguucggcgacaccgagaucaaggccaccgccaucgacaucgcgaccuccaagagcgugaagguggggaucgacuuccugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3960 - RNA, 2408 nt, Artificial Sequence
  mRNA product Design3 comprising derived and/or modified sequence from Homo sapiens__NP_443202.3 __HsHSPA12B (opt1)
gggagagucccgcagucggcguccagcggcucugcuuguucgugugugugucguugcaggccuuauucaagcuuaccaugcuggccgugcccgagaugggccuccaggggcuguacaucggcagcucccccgagcgcagccccguccccuccccgcccgggagcccccggacccaggaguccugcggcaucgccccgcugacccccagccagucccccaagcccgaggugcgcgcgccccagcaggccagcuucuccguggucguggccaucgacuucgggacgaccagcuccggcuacgccuucagcuucgccuccgaccccgaggcgauccacaugaugcggaagugggagggcggggacccgggcguggcccaccagaagaccccgaccugccuccugcugacgcccgagggggccuuccacagcuucggcuacaccgcccgcgacuacuaccacgaccucgaccccgaggaggcgcgggacuggcuguacuucgagaaguucaagaugaagauccacuccgccaccgaccugacccucaagacgcagcuggaggccgucaacgggaagaccaugcccgcccuggagguguucgcccacgcgcuccgcuucuuccgggagcacgcccugcaggagcugcgcgagcagagccccucccuccccgagaaggacaccgugcgguggguccugaccgugcccgccaucuggaagcagccggccaagcaguucaugcgcgaggccgcguaccuggccggccucgugagccgggagaacgccgagcagcugcugaucgcccucgagcccgaggccgcguccgucuacugccgcaagcugcggcugcaccagcuccuggaccugagcggccgcgcccccgggggcgggcggcucggcgagcgccggagcaucgacuccagcuuccgccaggcccgggagcagcugcgccggucccgccacagccgcacguuccugguggaguccggcgugggggagcucugggccgagaugcaggccggcgaccgguacgucguggcggacugcgggggcgggaccguggaccugaccguccaccagcuggagcagccccacggcacccucaaggagcuguacaaggccagcggcgggccguacggcgccguggggguggaccuggccuucgagcagcuccugugccgcaucuucggcgaggacuucaucgcgacguucaagcggcagcgccccgccgccugggucgaccugaccaucgccuucgaggcccggaagcgcaccgcggggccccaccgggccggcgcccucaacaucucccugcccuucagcuucaucgacuucuaccgcaagcagcggggccacaacguggagaccgcccugcgccgguccagcgugaacuucgucaagugguccagccaggggaugcuccgcauguccugcgaggccaugaacgagcuguuccagccgacggugagcggcaucauccagcacaucgaggcgcugcucgcccggcccgagguccagggggugaagcugcuguuccucgugggcggguucgccgaguccgccguccugcagcacgccgugcaggcggcccugggcgcccgcggccugcggguggucgugccccacgacguggggcucaccauccugaagggcgccguccuguucgggcaggcgccgggcguggugcgcguccggcgcagcccccucaccuacggcgugggggugcugaaccgguucguccccggccgccacccgcccgagaagcugcucgugcgcgacgggcggcgcuggugcaccgacguguucgagcgguucgucgccgccgagcaguccguggcccugggcgaggaggugcgccggagcuacugccccgcccgccccgggcagcggcgcguccugaucaaccucuacugcugcgcggccgaggacgcccgguucaucacggaccccggcgugcgcaagugcggcgcccugucccuggagcucgagccggccgacugcgggcaggacaccgcgggcgccccgcccgggcggcgcgagauccgggccgccaugcaguucggcgacaccgagaucaaggugaccgccgucgacgugagcacgaaccgcagcgugcgggcguccaucgacuuccugagcaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3961 - RNA, 1763 nt, Artificial Sequence
  mRNA product Design3 comprising derived and/or modified sequence from Homo sapiens__NP_008879.3__HsHSPA13 (opt1)
gggagagucccgcagucggcguccagcggcucugcuuguucgugugugugucguugcaggccuuauucaagcuuaccauggcccgggagaugaccauccugggcagcgccgugcucacccugcugcucgcgggguaccuggcccagcaguaccugccccucccgacgcccaaggucaucggcaucgaccuggggaccaccuacugcuccgugggcguguucuuccccgggaccggcaaggucaaggugauccccgacgagaacggccacaucagcaucccguccauggugagcuucacggacaacgacgucuacgugggguacgaguccguggagcuggccgacagcaacccccagaacaccaucuacgacgccaagcgguucaucggcaagaucuucaccgccgaggagcucgaggcggagaucgggcgcuaccccuucaagguccugaacaagaacggcaugguggaguucuccgugaccagcaacgagacgaucaccgucucccccgaguacguggggagccggcugcuccugaagcugaaggagauggccgaggccuaccucggcaugccgguggccaacgcggucaucuccgugcccgccgaguucgaccugaagcagcgcaacagcaccaucgaggccgccaaccuggccggccucaagauccugcgggugaucaacgagcccaccgcggccgccauggccuacgggcugcacaaggccgacgucuuccacgugcucgugaucgaccugggcgggggcacgcuggacgucucccuccugaacaagcagggcgggauguuccugacccgcgcgaugagcggcaacaacaagcucgggggccaggacuucaaccagcggcugcugcaguaccucuacaagcagaucuaccagaccuacggguucgugcccucccgcaaggaggagauccaccggcugcgccaggccguggagauggucaagcugaaccucacccugcaccagagcgcccagcuguccgugcuccugacggucgaggagcaggaccggaaggagccgcacagcuccgacaccgagcugcccaaggacaagcucagcagcgccgacgaccaccgcgugaacuccggcuucggccgggggcugagcgacaagaaguccggcgagagccaggugcuguucgagaccgagaucucccgcaagcuguucgacacccugaacgaggaccuguuccagaagauccucguccccauccagcagguccugaaggaggggcaccuggagaagacggagaucgacgagguggugcucgugggcgggagcacccggaucccccgcauccgccaggugauccaggaguucuucggcaaggacccgaacaccuccgucgaccccgaccuggccguggugaccggcgucgcgauccaggccgggaucgacggcgggagcuggccccuccagguguccgcccuggagauccccaacaagcaccuccagaagacgaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3962 - RNA, 1877 nt, Artificial Sequence
  mRNA product Design3 comprising derived and/or modified sequence from Homo sapiens__NP_057383.2__HsHSPA14 (opt1)
gggagagucccgcagucggcguccagcggcucugcuuguucgugugugugucguugcaggccuuauucaagcuuaccauggccgccaucggcgugcaccuggggugcaccagcgcgugcgucgccguguacaaggacggccgcgccgggguggucgccaacgacgccggcgaccgggugacccccgcgguggucgccuacuccgagaacgaggagaucguggggcucgccgccaagcagagccgcauccggaacaucuccaacacggugaugaaggucaagcagauccugggccgcagcuccagcgacccgcaggcgcagaaguacaucgccgaguccaagugccuggugaucgagaagaacggcaagcuccgguacgagaucgacaccggggaggagaccaaguucgugaaccccgaggacgucgcccgccugaucuucagcaagaugaaggagaccgcccacuccgugcugggcagcgacgccaacgacguggucaucacggugcccuucgacuucggggagaagcagaagaacgcgcucggcgaggccgcccgggccgccggguucaacgugcugcgccugauccacgagcccuccgcggcccuccuggccuacggcaucggccaggacagcccgaccgggaaguccaacauccuggucuucaagcucggcgggaccagccugucccugagcgugauggaggugaacuccggcaucuaccggguccucagcaccaacacggacgacaacaucggcggggcccacuucaccgagacccuggcccaguaccuggcguccgaguuccagcgcagcuucaagcacgacgugcggggcaacgcccgcgccaugaugaagcucaccaacagcgccgagguggccaagcacucccugagcacgcugggguccgcgaacugcuuccucgacagccuguacgagggccaggacuucgacugcaacgucucccgggcccgcuucgagcugcucugcagcccccuguucaacaagugcaucgaggccauccgggggcugcucgaccagaacggcuucaccgccgacgacaucaacaaggugguccugugcggcggguccagccgcauccccaagcugcagcagcucaucaaggaccuguuccccgcgguggagcugcucaacuccaucccgcccgacgaggugauccccaucggcgccgccaucgaggccgggauccugaucggcaaggagaaccugcucgucgaggacagccugaugaucgagugcuccgcccgggacauccuggugaaggggguggacgagagcggcgcgucccgcuucaccguccucuuccccagcggcaccccgcugcccgcccggcgccagcacacgcugcaggcccccggguccaucagcuccgugugccucgagcuguacgagagcgacggcaagaacuccgccaaggaggagaccaaguucgcccaggugguccugcaggaccucgacaagaaggagaacgggcugcgggacauccuggcggugcucaccaugaagcgcgacggcagccugcacgugaccugcacggaccaggagaccgggaagugcgaggccaucagcaucgagaucgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3963 - RNA, 2924 nt, Artificial Sequence
  mRNA product Design3 comprising derived and/or modified sequence from Homo sapiens__NP_006635.2 __HsHSPH1 (opt1)
gggagagucccgcagucggcguccagcggcucugcuuguucgugugugugucguugcaggccuuauucaagcuuaccaugagcguggucggccuggacguggggucccagagcugcuacaucgccguggcccgcgcgggcgggaucgagaccaucgccaacgaguucuccgaccggugcacccccagcgucaucuccuucggcagcaagaaccgcaccaucgggguggccgccaagaaccagcagaucacccacgccaacaacaccguguccaacuucaagcgguuccacggccgcgcguucaacgacccguucauccagaaggagaaggagaaccucagcuacgaccuggucccccugaagaacggcggggugggcaucaaggugauguacaugggggaggagcaccucuucuccgucgagcagaucaccgccaugcugcugacgaagcucaaggagaccgccgagaacagccugaagaagcccgugaccgacugcgugaucuccguccccagcuucuucaccgacgccgagcggcgcuccgugcuggacgcggcccagaucgugggccucaacugccugcggcugaugaacgacaugacggccgucgcccucaacuacgggaucuacaagcaggaccugccgagccuggacgagaagccccgcaucgugguguucgucgacaugggccacuccgccuuccaggugagcgcgugcgccuucaacaagggcaagcucaaggugcuggggaccgccuucgaccccuuccugggcgggaagaacuucgacgagaagcucgucgagcacuucugcgccgaguucaagaccaaguacaagcuggacgccaaguccaagauccgggcgcugcuccgccuguaccaggagugcgagaagcugaagaagcucaugagcuccaacagcaccgaccugccccugaacaucgagugcuucaugaacgacaaggacgugagcggcaagaugaaccggucccaguucgaggagcucugcgccgagcugcugcagaagaucgaggugccgcucuacagccugcuggagcagacgcaccucaaggucgaggacguguccgccgucgagaucgugggcggggccacccgcauccccgccgugaaggagcggaucgcgaaguucuucggcaaggacaucagcaccacccugaacgccgacgaggccgucgcccgcgggugcgcccugcagugcgcgauccucucccccgccuucaaggugcgggaguucagcgugacggacgccguccccuucccgaucucccugaucuggaaccacgacagcgaggacaccgagggcgugcacgagguguucucccgcaaccacgccgcgcccuucagcaagguccugaccuuccuccggcgcgggcccuucgagcuggaggccuucuacuccgacccccagggcgugccguaccccgaggccaagaucggccgguucgugguccagaacgugagcgcccagaaggacggggagaagucccgcgugaaggucaaggugcgggugaacacccacggcaucuucacgaucagcaccgccuccauggucgagaaggugcccaccgaggagaacgagaugagcuccgaggcggacauggagugccugaaccagcggcccccggagaaccccgacaccgacaagaacgugcagcaggacaacagcgaggccgggacgcagccccagguccagaccgacgcccagcagaccucccagagcccgcccagccccgagcucaccuccgaggagaacaagauccccgacgccgacaaggccaacgagaagaagguggaccagcccccggaggcgaagaagcccaagaucaagguggucaacguggagcugcccaucgaggccaaccugguguggcagcucggcaaggaccugcugaacauguacaucgagacggaggggaagaugaucaugcaggacaagcucgagaaggagcgcaacgacgccaagaacgccgucgaggaguacguguacgaguuccgcgacaagcugugcggcccguacgagaaguucaucugcgagcaggaccaccagaacuuccugcgccugcucaccgagaccgaggacuggcuguacgaggagggcgaggaccaggccaagcaggcguacguggacaagcuggaggagcucaugaagaucgggacccccgucaaggugcgguuccaggaggccgaggagcgccccaagauguucgaggagcugggccagcggcugcagcacuacgccaagaucgccgcggacuuccgcaacaaggacgagaaguacaaccacaucgacgagagcgagaugaagaagguggagaaguccgucaacgaggugauggaguggaugaacaacgugaugaacgcccaggccaagaagucccucgaccaggaccccgucgugcgggcccaggagaucaagacgaagaucaaggagcugaacaacacgugcgagccgguggucacccagcccaagcccaagaucgagagccccaagcuggagcgcaccccgaacgggcccaacaucgacaagaaggaggaggaccucgaggacaagaacaacuucggcgccgagccgccccaccagaacggggagugcuaccccaacgagaagaacagcgugaacauggaccuggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3964 - RNA, 3347 nt, Artificial Sequence
  mRNA product Design3 comprising derived and/or modified sequence from Homo sapiens__NP_006380.1 __HsHYOU1 (opt1)
gggagagucccgcagucggcguccagcggcucugcuuguucgugugugugucguugcaggccuuauucaagcuuaccauggccgacaaggugcgccggcagcgcccccggcgccgggucugcugggcccugguggcggugcuccuggccgaccugcucgcccugagcgacacccuggccgucauguccguggaccucggcagcgaguccaugaagguggccaucgucaagccgggggugcccauggagaucgugcugaacaaggagagccgccggaagacccccgucaucgugacgcugaaggagaacgagcgcuucuucggcgacuccgcggccagcauggccaucaagaaccccaaggccacccuccgguacuuccagcaccuccuggggaagcaggcggacaacccgcacguggcccuguaccaggcccgcuuccccgagcacgagcugaccuucgacccccagcggcagaccguccacuuccagaucuccagccagcugcaguucucccccgaggaggugcucggcauggugcugaacuacagccgcucccuggccgaggacuucgccgagcagccgaucaaggacgcggucaucacggugcccguguucuucaaccaggccgagcggcgcgccguccuccaggccgcccggauggcggggcugaaggugcugcagcucaucaacgacaacaccgccaccgcccugagcuacggcguguuccgccggaaggacaucaacaccacggcccagaacaucauguucuacgacaugggcuccgggagcaccgucugcaccaucgugaccuaccagauggugaagacgaaggaggccggcaugcagccccagcugcagauccgcggggucggcuucgaccggacccucgggggccuggagauggagcugcgccuccgggagcgccuggcgggccuguucaacgagcagcgcaaggggcagcgggccaaggacgugcgcgagaacccccgggccauggccaagcuccugcgcgaggccaaccggcugaagaccguccucuccgcgaacgccgaccacauggcccagaucgagggccugauggacgacguggacuucaaggccaaggugacccgcgucgaguucgaggagcugugcgcggaccucuucgagcgggugccggggcccgugcagcaggcccugcagagcgccgagaugucccuggacgagaucgagcaggucauccucgugggcggcgccacgcgcgugccccggguccaggaggugcugcugaaggccguggggaaggaggagcucggcaagaacaucaacgcggacgaggccgccgccaugggggccgucuaccaggcggccgcccugagcaaggccuucaaggugaagcccuucgugguccgcgacgccgugguguacccgauccuggucgaguucacccgggagguggaggaggagcccggcauccacucccucaagcacaacaagcgcgugcuguucagccggauggggcccuacccccagcgcaaggucaucaccuucaaccgguacagccacgacuucaacuuccacaucaacuacggcgaccugggcuuccucgggccggaggaccugcgcguguucggcucccagaaccugaccacggugaagcugaagggggucggcgacagcuucaagaaguaccccgacuacgaguccaaggggaucaaggcgcacuucaaccucgacgagagcggcgugcugucccuggaccggguggagagcgucuucgagacccucguggaggacuccgccgaggaggagagcacccugaccaagcugggcaacacgaucuccagccucuucgggggcgggaccacccccgacgccaaggagaacggcaccgacacggugcaggaggaggaggagucccccgccgaggggagcaaggacgagccgggcgagcaggucgagcugaaggaggaggcggaggcccccguggaggacggcucccagccgccgccgcccgagcccaagggggacgccacccccgagggcgagaaggccaccgagaaggagaacggggacaagagcgaggcccagaagcccuccgagaaggcggaggccggccccgagggcguggcccccgcccccgagggggagaagaagcagaagcccgcccgcaagcggcgcauggucgaggagaucggcguggagcuggugguccucgaccugcccgaccugcccgaggacaagcucgcgcagagcgugcagaagcugcaggaccugacccuccgcgaccuggagaagcaggagcgggagaaggccgccaacucccuggaggccuucaucuucgagacgcaggacaagcucuaccagccggaguaccaggaggugagcaccgaggagcagcgcgaggagaucuccgggaagcugagcgccgcgagcaccuggcuggaggacgagggcgucggggccaccacggugaugcucaaggagaagcuggccgagcugcggaagcucugccagggccuguucuuccgcguggaggagcggaagaaguggcccgagcgccuguccgcccucgacaaccugcugaaccacagcuccauguuccucaagggcgcgcggcugauccccgagauggaccagaucuucaccgaggucgagaugaccacccuggagaaggugaucaacgagaccugggccuggaagaacgccacgcucgccgagcaggccaagcugcccgcgaccgagaagccggugcugcucagcaaggacaucgaggccaagaugauggcccuggaccgcgagguccaguaccugcucaacaaggccaaguucaccaagccccggccccgccccaaggacaagaacgggacccgggccgagccgccccugaacgcguccgccagcgaccagggcgagaaggugaucccgcccgccgggcagacggaggacgccgagcccaucuccgagcccgagaagguggagaccggcagcgagcccggggacaccgagccccuggagcucggcggcccgggggccgagcccgagcagaaggagcaguccaccggccagaagcgcccccugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3965 - RNA, 2546 nt, Artificial Sequence
  mRNA product Design3 comprising derived and/or modified sequence from Homo sapiens__NP_005339.3 __HsHSP90AA1 (opt1)
gggagagucccgcagucggcguccagcggcucugcuuguucgugugugugucguugcaggccuuauucaagcuuaccaugcccgaggagacccagacccaggaccagcccauggaggaggaggagguggagacguucgccuuccaggccgagaucgcgcagcugaugagccucaucaucaacaccuucuacuccaacaaggagaucuuccugcgcgagcugaucagcaacuccagcgacgcccucgacaagauccgguacgagucccugaccgaccccagcaagcuggacuccggcaaggagcuccacaucaaccugauccccaacaagcaggaccgcacccugacgaucgucgacaccgggaucggcaugaccaaggccgaccucaucaacaaccuggggaccaucgccaagagcggcacgaaggccuucauggaggcgcugcaggccggggccgacaucuccaugaucggccaguucggcgugggguucuacagcgccuaccucguggcggagaaggucaccgugaucaccaagcacaacgacgacgagcaguacgccugggaguccagcgccggcggguccuucaccgugcggacggacaccggcgagcccauggggcgcggcaccaaggucauccugcaccugaaggaggaccagaccgaguaccucgaggagcggcgcaucaaggagaucgugaagaagcacagccaguucaucggcuacccgaucacgcuguucguggagaaggagcgggacaaggaggucuccgacgacgaggccgaggagaaggaggacaaggaggaggagaaggagaaggaggagaaggagagcgaggacaagcccgagaucgaggacgugggguccgacgaggaggaggagaagaaggacggcgacaagaagaagaagaagaagaucaaggagaaguacaucgaccaggaggagcugaacaagaccaagcccaucuggacccgcaaccccgacgacaucaccaacgaggaguacggggaguucuacaagagccucacgaacgacugggaggaccaccuggccgugaagcacuucuccgucgagggccagcuggaguuccgggcgcuccuguucgugccgcgccgggcccccuucgaccuguucgagaaccgcaagaagaagaacaacaucaagcucuacgugcggcgcgucuucaucauggacaacugcgaggagcugauccccgaguaccugaacuucauccggggcgugguggacagcgaggaccucccccugaacaucagccgcgagaugcugcagcaguccaagauccucaaggucauccggaagaaccuggugaagaagugccuggagcuguucaccgagcucgccgaggacaaggagaacuacaagaaguucuacgagcaguucagcaagaacaucaagcuggggauccacgaggacucccagaaccgcaagaagcucagcgagcugcugcgguacuacaccuccgccagcggcgacgagauggugucccucaaggacuacugcacccgcaugaaggagaaccagaagcacaucuacuacaucacgggggagaccaaggaccaggucgccaacagcgcguucguggagcggcugcgcaagcacggccuggaggugaucuacaugaucgagccgaucgacgaguacugcguccagcagcucaaggaguucgaggggaagacccugguguccgucaccaaggagggccuggagcuccccgaggacgaggaggagaagaagaagcaggaggagaagaagacgaaguucgagaaccugugcaagaucaugaaggacauccuggagaagaagguggagaagguggucgugagcaaccgccucgugaccucccccugcugcaucgucaccagcaccuacggcuggacggccaacauggagcggaucaugaaggcccaggcccugcgcgacaacuccaccaugggguacauggccgcgaagaagcaccuggagaucaaccccgaccacagcaucaucgagacccugcggcagaaggccgaggccgacaagaacgacaaguccgugaaggaccucgugauccugcuguacgagaccgcccuccugagcuccggcuucagccuggaggacccgcagacgcacgccaaccgcaucuaccggaugaucaagcucgggcugggcaucgacgaggacgaccccaccgcggacgacaccuccgccgccgucaccgaggagaugccgccccuggagggggacgacgacaccagccgcauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3966 - RNA, 686 nt, Artificial Sequence
  mRNA product Design3 comprising derived and/or modified sequence from Homo sapiens__NG_005218__HsHSP90AA3P (opt1)
gggagagucccgcagucggcguccagcggcucugcuuguucgugugugugucguugcaggccuuauucaagcuuaccauggacagcuccaagcuggacagcggcaaggggcuccacaucaaccuggugcccaacaagcagaaccagacccugaccaucgucgacacgcgcaucggcaugaccaagaccgaccucaucaacaaccuggggaccgugacgaaguccggcaccaaggccuucauggaggcccugcaggcggacgccgacaucagcaugaucgggcacuucggcgugggcuucuacuccgccuaccucgucgccaagaaggugaccgugaucagcaagcacaacaacgacgagcaguacaccugggaguccagcgccgggggcuccuucacgguccggaccgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3967 - RNA, 2522 nt, Artificial Sequence
  mRNA product Design3 comprising derived and/or modified sequence from Homo sapiens__NP_031381.2__HsHSP90AB1 (opt1)
gggagagucccgcagucggcguccagcggcucugcuuguucgugugugugucguugcaggccuuauucaagcuuaccaugcccgaggaggugcaccacggcgaggaggaggucgagaccuucgccuuccaggccgagaucgcgcagcugaugagccucaucaucaacaccuucuacuccaacaaggagaucuuccugcgcgagcugaucagcaacgccuccgacgcccucgacaagauccgguacgagagccugacggacccguccaagcuggacagcgggaaggagcucaagaucgacaucauccccaacccccaggagcgcacccugacccugguggacaccggcaucgggaugacgaaggccgaccucaucaacaaccugggcaccaucgccaaguccgggaccaaggcguucauggaggcccugcaggccggcgccgacaucagcaugaucggccaguucggggugggcuucuacuccgcguaccucgucgccgagaaggugguggucaucaccaagcacaacgacgacgagcaguacgccugggagagcuccgccgggggcagcuucacggugcgggccgaccacggggagcccaucggccgcggcaccaaggugauccugcaccugaaggaggaccagaccgaguaccucgaggagcggcgcgucaaggagguggugaagaagcacucccaguucaucggguacccgaucacccuguaccuggagaaggagcgggagaaggagaucagcgacgacgaggcggaggaggagaagggcgagaaggaggaggaggacaaggacgacgaggagaagcccaagaucgaggacgucggguccgacgaggaggacgacagcggcaaggacaagaagaagaagacgaagaagaucaaggagaaguacaucgaccaggaggagcucaacaagaccaagcccaucuggacccgcaaccccgacgacaucacccaggaggaguacggcgaguucuacaagucccugacgaacgacugggaggaccaccuggccgugaagcacuucagcguggaggggcagcucgaguuccgggcccugcuguucaucccgcgccgggcccccuucgaccucuucgagaacaagaagaagaagaacaacaucaagcuguacguccgccggguguucaucauggacuccugcgacgagcugauccccgaguaccucaacuucauccgcggcguggucgacagcgaggaccugccccugaacaucagccgggagaugcuccagcaguccaagauccugaaggugauccgcaagaacaucgugaagaagugccuggagcuguucagcgagcucgccgaggacaaggagaacuacaagaaguucuacgaggcguucuccaagaaccugaagcucgggauccacgaggacagcaccaaccggcgccggcuguccgagcugcuccgcuaccacaccagccaguccggcgacgagaugaccagccuguccgaguacgucagccggaugaaggagacgcagaaguccaucuacuacaucaccggggagagcaaggagcaggucgccaacuccgccuucguggagcgcgugcgcaagcggggcuucgagguggucuacaugaccgagccgaucgacgaguacugcgugcagcagcugaaggaguucgacggcaagagccucguguccgucaccaaggaggggcuggagcugcccgaggacgaggaggagaagaagaagauggaggagagcaaggccaaguucgagaaccucugcaagcugaugaaggagauccuggacaagaagguggagaaggugacgaucuccaaccgccucgucagcucccccugcugcaucgugaccagcaccuacggcuggaccgccaacauggagcggaucaugaaggcgcaggcccugcgcgacaacagcacgaugggguacaugauggccaagaagcaccuggagaucaaccccgaccacccgaucguggagacccugcggcagaaggccgaggccgacaagaacgacaaggcggucaaggaccucguggugcugcuguucgagaccgcccuccuguccagcggcuucucccuggaggacccccagacccacagcaaccgcaucuaccggaugaucaagcucgggcugggcaucgacgaggacgaggucgccgccgaggagcccaacgcggccgugcccgacgagaucccgccccuggagggcgacgaggacgccucccgcauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3968 - RNA, 2759 nt, Artificial Sequence
  mRNA product Design3 comprising derived and/or modified sequence from Homo sapiens__NP_003290.1__HsHSP90B1 (opt1)
gggagagucccgcagucggcguccagcggcucugcuuguucgugugugugucguugcaggccuuauucaagcuuaccaugcgcgcccugugggugcucggccugugcugcguccugcucaccuucgggagcgugcgggccgacgacgagguggacgucgacggcaccguggaggaggaccuggggaagucccgcgagggcagccggacggacgacgaggugguccagcgcgaggaggaggcgauccagcuggacgggcucaacgccucccagauccgggagcugcgcgagaaguccgagaaguucgccuuccaggccgaggugaaccggaugaugaagcugaucaucaacagccucuacaagaacaaggagaucuuccugcgcgagcugaucagcaacgccuccgacgcgcucgacaagauccggcugaucagccugaccgacgagaacgcccucuccggcaacgaggagcugaccgugaagaucaagugcgacaaggagaagaaccugcuccacgucaccgacacgggcguggggaugacccgcgaggagcuggugaagaaccugggcaccaucgccaagagcgggaccuccgaguuccucaacaagaugacggaggcccaggaggacggccagagcaccuccgagcugaucgggcaguucggcgucggcuucuacagcgcguuccugguggccgacaaggugaucgucaccuccaagcacaacaacgacacccagcacaucugggagagcgacuccaacgaguucagcgugaucgccgacccccgggggaacacgcucggccgcgggaccaccaucacccuggugcugaaggaggaggccuccgacuaccucgagcuggacacgaucaagaaccuggucaagaaguacagccaguucaucaacuucccgaucuacguguggagcuccaagaccgagaccguggaggagcccauggaggaggaggaggccgcgaaggaggagaaggaggagagcgacgacgaggccgccgucgaggaggaggaggaggagaagaagcccaagaccaagaagguggagaagacggugugggacugggagcucaugaacgacaucaagcccaucuggcagcggccguccaaggaggucgaggaggacgaguacaaggccuucuacaagagcuucuccaaggagagcgacgaccccauggccuacauccacuucaccgcggagggcgaggugaccuucaaguccauccuguucguccccaccagcgcgccccgcggccuguucgacgaguacggguccaagaaguccgacuacaucaagcucuacgugcggcgcguguucaucacggacgacuuccacgacaugaugccgaaguaccugaacuucgucaagggcgugguggacagcgacgaccugccccucaacgucagccgggagacccugcagcagcacaagcugcucaaggugauccgcaagaagcuggugcggaagacccuggacaugaucaagaagaucgccgacgacaaguacaacgacaccuucuggaaggaguucgggacgaacaucaagcucggcgucaucgaggaccacuccaaccgcacccggcuggccaagcugcuccgcuuccagagcucccaccaccccaccgacaucaccagccuggaccaguacguggagcgcaugaaggagaagcaggacaagaucuacuucauggccggguccagccggaaggaggccgaguccagccccuucguggagcgccugcucaagaagggcuacgaggucaucuaccugacggagccgguggacgaguacugcauccaggcccugcccgaguucgacggcaagcgguuccagaacguggccaaggagggggucaaguucgacgagagcgagaagaccaaggagucccgcgaggccguggagaaggaguucgagccccugcucaacuggaugaaggacaaggcccugaaggacaagaucgagaaggcgguggucagccagcggcugaccgagucccccugcgcccucguggccagccaguacggcugguccgggaacauggagcgcaucaugaaggcccaggcguaccagaccggcaaggacaucagcacgaacuacuacgccucccagaagaagaccuucgagaucaacccgcggcacccccugauccgcgacaugcugcggcgcaucaaggaggacgaggacgacaagaccgugcucgaccuggccgucgugcuguucgagaccgccacccuccggagcggguaccugcugcccgacacgaaggccuacggcgaccgcaucgagcggaugcuccgccugucccugaacaucgaccccgacgcgaagguggaggaggagccggaggaggagcccgaggagaccgccgaggacaccaccgaggacacggagcaggacgaggacgaggagauggacgucggcaccgacgaggaggaggagaccgccaaggagagcaccgccgagaaggacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3969 - RNA, 2462 nt, Artificial Sequence
  mRNA product Design3 comprising derived and/or modified sequence from Homo sapiens__NP_057376.2__HsTRAP1 (opt1)
gggagagucccgcagucggcguccagcggcucugcuuguucgugugugugucguugcaggccuuauucaagcuuaccauggcccgcgagcugcgggcccuccugcuguggggccgccggcuccgcccccugcugcgggcgccggcccucgccgccgugcccgggggcaagcccauccugugcccccgccggaccaccgcccagcuggggccgcgccggaaccccgcguggagccuccaggccggccgccuguucuccacgcagaccgccgaggacaaggaggagccccugcacagcaucaucuccagcaccgaguccguccaggggagcaccuccaagcacgaguuccaggccgagacgaagaagcuccuggacaucguggcgcggagccuguacuccgagaaggagguguucauccgcgagcucaucagcaacgccuccgacgcccuggagaagcugcggcacaagcucgucagcgacggccaggcccugcccgagauggagauccaccuccagaccaacgccgagaagggcaccaucaccauccaggacacggggaucggcaugacccaggaggagcugguguccaaccuggggaccaucgcgcgcagcggcuccaaggccuuccuggacgcccuccagaaccaggccgaggccagcuccaagaucaucgggcaguucggcgugggcuucuacagcgcguucauggucgccgaccggguggagguguacucccgcagcgccgccccggggagccugggcuaccaguggcuguccgacgggagcggcgucuucgagaucgccgaggcguccggcgugcggaccgggacgaagaucaucauccaccucaagagcgacugcaaggaguucuccagcgaggcccgcgugcgggacgucgugaccaaguacuccaacuucgugagcuucccccuguaccugaacggccgccggaugaacacccuccaggccaucuggaugauggaccccaaggacguccgcgaguggcagcacgaggaguucuaccgcuacguggcccaggcccacgacaagccccgguacacccugcacuacaagacggacgcgccgcugaacauccgcuccaucuucuacgugcccgacaugaagcccagcauguucgacgucucccgggagcucgggagcuccguggcccuguacagccgcaaggugcugauccagaccaaggccaccgacauccuccccaaguggcugcgguucauccgcggcgucguggacuccgaggacaucccgcugaaccucagccgggagcugcugcaggaguccgcccucauccgcaagcugcgggacgugcugcagcagcgccucaucaaguucuucaucgaccagagcaagaaggacgcggagaaguacgccaaguucuucgaggacuacgggcuguucaugcgggagggcaucgucaccgccacggagcaggaggugaaggaggacaucgccaagcugcuccgcuacgaguccagcgcccugcccagcggccagcugaccucccugagcgaguacgcgucccggaugcgcgccgggacccggaacaucuacuaccucugcgcccccaaccgccaccuggccgagcacagccccuacuacgaggccaugaagaagaaggacaccgagguccuguucugcuucgagcaguucgacgagcucacgcugcugcaccuccgggaguucgacaagaagaagcugaucuccguggagaccgacaucguggucgaccacuacaaggaggagaaguucgaggaccgcagcccggcggccgagugccuguccgagaaggagaccgaggagcucauggccuggaugcggaacgugcugggcagccgcgugaccaacgucaaggugacgcugcgccucgacacccaccccgccauggugaccguccuggagaugggggccgcgcggcacuuccugcgcaugcagcagcucgccaagacccaggaggagcgggcccagcugcugcagcccacgcucgagaucaacccccgccacgcccugaucaagaagcugaaccagcuccgggcguccgagccgggccuggcccagcugcucguggaccagaucuacgagaacgccaugaucgccgccgggcugguggacgacccccgcgcgauggucggccggcugaacgagcuccuggugaaggcccuggagcgccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3970 - RNA, 809 nt, Artificial Sequence
  mRNA product Design3 comprising derived and/or modified sequence from Homo sapiens__NP_000609.1__HsIGF1 (opt1)
gggagagucccgcagucggcguccagcggcucugcuuguucgugugugugucguugcaggccuuauucaagcuuaccaugggcaagaucagcucccugcccacccagcuguucaagugcugcuucugcgacuuccucaaggugaagaugcacaccaugagcuccagccaccuguucuaccucgcccugugccugcucacguucaccuccagcgccaccgcggggccggagacccugugcggcgccgagcuggucgacgcccuccaguucgugugcggggaccgcggcuucuacuucaacaagcccacgggguacggcuccagcucccggcgcgcgccccagaccggcaucguggacgagugcugcuuccggagcugcgaccugcgccggcuggagauguacugcgcgccccucaagccggccaaguccgcccgcagcguccgggcccagcgccacaccgacaugcccaagacccagaaggaggugcaccugaagaacgccucccgggggagcgccggcaacaagaacuaccgcaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3971 - RNA, 890 nt, Artificial Sequence
  mRNA product Design3 comprising derived and/or modified sequence from Homo sapiens__NP_000603.1__HsIGF2 (opt1)
gggagagucccgcagucggcguccagcggcucugcuuguucgugugugugucguugcaggccuuauucaagcuuaccaugggcauccccauggggaaguccaugcuggugcuccugaccuuccuggccuucgccagcugcugcaucgcggccuaccgcccgagcgagacccucugcggcggggagcuggucgacacgcugcaguucgugugcggcgaccggggguucuacuucucccgccccgccagccgggugucccgccggagccgcggcaucgucgaggagugcugcuuccgguccugcgaccucgcccugcuggagaccuacugcgccacccccgccaagagcgagcgcgacguguccacgcccccgaccgugcuccccgacaacuucccccgguaccccgucggcaaguucuuccaguacgacaccuggaagcagagcacccagcgccugcggcgcgggcugccggcgcuccugcgggcccgccggggccacgugcuggccaaggagcucgaggcguuccgcgaggccaagcggcaccgcccccugaucgcccugcccacccaggaccccgcccacgggggcgccccgcccgagauggcguccaaccggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3972 - RNA, 986 nt, Artificial Sequence
  mRNA product Design3 comprising derived and/or modified sequence from Homo sapiens__NP_000591.1__HsIL6 (opt1)
gggagagucccgcagucggcguccagcggcucugcuuguucgugugugugucguugcaggccuuauucaagcuuaccaugaacagcuucuccaccagcgccuucggccccguggccuucucccuggggcuccugcugguccucccggcggccuuccccgcccccgugcccccgggcgaggacagcaaggacguggccgcgccccaccgccagccccugaccuccagcgagcggaucgacaagcagauccgcuacauccuggacgggaucuccgcccuccggaaggagacgugcaacaagagcaacaugugcgaguccagcaaggaggcccuggccgagaacaaccugaaccuccccaagauggccgagaaggacggcugcuuccaguccggguucaacgaggagaccugccuggucaagaucaucaccggccugcucgaguucgagguguaccuggaguaccugcagaaccgcuucgagagcuccgaggagcaggcgcgggccgugcagaugagcaccaagguccucauccaguuccugcagaagaaggccaagaaccuggacgccaucacgaccccggaccccaccaccaacgccucccuccugacgaagcugcaggcgcagaaccaguggcuccaggacaugaccacccaccugauccugcgcagcuucaaggaguuccuccaguccagccugcgggcccugcgccagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3973 - RNA, 1628 nt, Artificial Sequence
  mRNA product Design3 comprising derived and/or modified sequence from Homo sapiens__NP_002183.1__HsINHBA (opt1)
gggagagucccgcagucggcguccagcggcucugcuuguucgugugugugucguugcaggccuuauucaagcuuaccaugccccugcucuggcugcgcggcuuccugcucgccagcugcuggaucaucgugcgguccagcccgacccccggguccgagggccacagcgccgcgcccgacugccccuccugcgcccuggccgcccugccgaaggacguccccaacagccagcccgagaugguggaggccgugaagaagcacauccucaacaugcugcaccugaagaagcgccccgacgucacccagccggugcccaaggcggcccuccugaacgccauccggaagcugcacguggggaaggucggcgagaacggguacguggagaucgaggacgacaucggccgccgggccgagaugaacgagcucauggagcagacguccgagaucaucaccuucgcggagagcggcaccgcccgcaagacccugcacuucgagaucuccaaggaggggagcgaccuguccguggucgagcgggccgagguguggcuguuccucaaggugcccaaggccaaccgcacgcggaccaaggucaccauccgccuguuccagcagcagaagcacccccagggcagccucgacaccggggaggaggccgaggaggugggccugaagggggagcgguccgagcugcuccugagcgagaagguggucgacgcgcgcaaguccacguggcacguguucccggugagcuccagcauccagcggcugcucgaccagggcaaguccagccuggacguccgcaucgccugcgagcagugccaggagagcggcgccucccuggugcuccuggggaagaagaagaagaaggaggaggagggcgaggggaagaagaagggcggcggggagggcggggccggcgccgacgaggagaaggagcagagccaccggcccuuccugaugcuccaggcgcgccaguccgaggaccacccccaccggcgccggcgccgggggcuggagugcgacggcaaggugaacaucugcugcaagaagcaguucuucgucagcuucaaggacaucggcuggaacgacuggaucaucgcccccuccggguaccacgccaacuacugcgagggcgagugcccgagccacaucgccgggaccuccggcagcucccugagcuuccacuccaccgugaucaaccacuaccgcaugcgcgggcacagccccuucgccaaccucaaguccugcugcgugcccaccaagcugcggcccaugagcaugcuguacuacgacgacggccagaacaucaucaagaaggacauccagaacaugaucgucgaggagugcggcugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3974 - RNA, 1571 nt, Artificial Sequence
  mRNA product Design3 comprising derived and/or modified sequence from Homo sapiens__NP_002184.2__HsINHBB (opt1)
gggagagucccgcagucggcguccagcggcucugcuuguucgugugugugucguugcaggccuuauucaagcuuaccauggacggccugcccgggcgcgcccucggcgccgcgugccugcugcuccuggccgccggguggcugggcccggaggccugggggagccccaccccgcccccgacccccgccgcgcccccgcccccgcccccgcccggcucccccggcgggagccaggacacgugcaccuccugcggcggguuccggcgccccgaggagcucggccggguggacggggacuuccuggaggccgucaagcgccacauccugagccggcuccagaugcgcggccggcccaacaucacccacgccgugcccaaggccgcgauggugaccgcccugcgcaagcugcacgccggcaagguccgggaggacgggcgcguggagaucccccaccucgacggccacgccucccccggggccgacggccaggagcgggugagcgagaucaucuccuucgcggagacggacggccuggccagcucccgcguccggcuguacuucuucaucagcaacgaggggaaccagaaccucuucguggugcaggccucccuguggcuguaccucaagcugcugcccuacguccucgagaagggcagccgccggaaggugcgcgugaaggucuacuuccaggagcaggggcacggcgaccgguggaacaugguggagaagcgcguggaccugaagcgguccggguggcacaccuucccccugaccgaggccauccaggcccucuucgagcgcggcgagcggcgccugaaccuggacguccagugcgacagcugccaggagcucgcgguggugcccgucuucguggaccccggcgaggagucccaccgccccuucguggucgugcaggcccggcugggggacagccgccaccggauccgcaagcggggccuggagugcgacgggcgcaccaaccucugcugccggcagcaguucuucaucgacuuccgccugaucggcuggaacgacuggaucaucgccccgacgggguacuacggcaacuacugcgagggcuccugccccgccuaccuggccggggugcccggcagcgcguccagcuuccacaccgccgucgugaaccaguaccggaugcgcgggcucaaccccggcaccgucaacagcugcugcaucccgaccaagcuguccacgaugagcaugcuguacuucgacgacgaguacaacaucgugaagcgggacgugcccaacaugaucgucgaggagugcgggugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3975 - RNA, 3806 nt, Artificial Sequence
  mRNA product Design3 comprising derived and/or modified sequence from Homo sapiens__NP_000623.2__HsITGAM (opt1)
gggagagucccgcagucggcguccagcggcucugcuuguucgugugugugucguugcaggccuuauucaagcuuaccauggcccugcgcgugcuccugcugaccgcccucacccugugccacggcuucaaccuggacacggagaacgcgaugaccuuccaggagaacgcccggggguucggccagagcgucgugcagcuccaggggucccgcguggucgugggcgccccccaggagaucguggccgccaaccagcgggggagccuguaccagugcgacuacuccaccggcagcugcgagccgauccgccugcagguccccguggaggcggugaacaugucccucggccugagccuggccgccaccacgucccccccccagcuccuggccugcgggccgaccguccaccagaccugcagcgagaacaccuacgugaagggccugugcuuccucuucggguccaaccugcggcagcagccccagaaguuccccgaggcgcugcgcggcugcccccaggaggacagcgacaucgccuuccucaucgacggguccggcagcaucaucccgcacgacuuccggcgcaugaaggaguucguguccacggucauggagcagcugaagaaguccaagacccuguucucccucaugcaguacagcgaggaguuccggauccacuucaccuucaaggaguuccagaacaaccccaacccccgcucccuggugaagcccaucacccagcugcucggccggacgcacaccgccaccgggauccgcaaggugguccgggagcuguucaacaucaccaacggcgcccgcaagaacgccuucaagauccugguggugaucacggacggggagaaguucggcgacccgcucggcuacgaggacgucauccccgaggcggaccgggagggggugauccgcuacgugaucggcgucggggacgccuuccggagcgagaagucccgccaggagcugaacaccaucgccagcaagcccccccgggaccacguguuccaggugaacaacuucgaggcccugaagaccauccagaaccagcuccgcgagaagaucuucgccaucgagggcacccagacggggagcuccagcuccuucgagcacgagaugagccaggagggcuucuccgcggccaucaccagcaacggcccgcugcuguccaccgucgggagcuacgacugggccggcgggguguuccucuacaccuccaaggagaaguccacguucaucaacaugacccgggucgacuccgacaugaacgacgccuaccugggcuacgccgcggccaucauccugcgcaaccgcgugcagagccucgugcugggggccccccgguaccagcacaucggccuggucgccauguuccgccagaacaccggcaugugggaguccaacgccaacgugaaggggacccagaucggcgcguacuucggggccagccucugcuccguggacgucgacagcaacggcuccacggaccuggugcugaucggggccccccacuacuacgagcagacccggggcggccaggugagcgucugcccccucccgcgcgggcgggcccgcuggcagugcgacgcggugcuguacggcgagcaggggcagcccuggggccgguucggcgccgcccugaccgugcucggggacgucaacggcgacaagcugaccgacguggccaucggggcccccggcgaggaggacaaccgcggggcgguguaccuguuccacggcacguccggcagcgggaucagccccucccacagccagcggaucgccggcuccaagcucagcccgcgccugcaguacuucgggcagucccugagcggcgggcaggaccugaccauggacggccucgucgaccugaccgugggcgcccaggggcacgugcugcuccugcggucccagcccguccugcgcgugaaggccaucauggaguucaacccccgggagguggcccgcaacgucuucgagugcaacgaccagguggugaagggcaaggaggcgggggagguccgggugugccuccacgugcagaaguccacccgcgaccggcugcgcgagggccagauccaguccgucgugacguacgaccuggcccucgacagcgggcggccccacucccgcgccguguucaacgagaccaagaacagcacccgccggcagacccagguccugggccugacccagacgugcgagacccucaagcugcagcugccgaacugcaucgaggaccccgugucccccaucgugcuccgccugaacuucagccuggucggcaccccgcucuccgccuucgggaaccugcggcccgugcuggccgaggacgcgcagcgccucuucaccgcccuguuccccuucgagaagaacugcggcaacgacaacaucugccaggacgaccugagcaucacguucuccuucaugagccucgacugccugguggucgggggcccccgggaguucaacgugaccgugaccguccgcaacgacggggaggacagcuaccggacccaggugacguucuucuucccgcuggaccucuccuaccgcaaggugagcacccugcagaaccagcggucccagcgcagcuggcggcuggccugcgaguccgccagcuccaccgaggucagcggcgcgcucaaguccaccagcugcuccaucaaccaccccaucuuccccgagaacagcgaggugacguucaacaucaccuucgacguggacuccaaggccagccugggcaacaagcugcuccugaaggccaacgucaccuccgagaacaacaugccccgcaccaacaagacggaguuccagcuggagcucccggugaaguacgccguguacauggucgugaccagccacgggguguccaccaaguaccugaacuucaccgccagcgagaacacgucccgggucaugcagcaccaguaccaggugagcaaccugggccagcgcagccuccccaucucccuggucuuccuggugcccgugcggcucaaccagaccgucaucugggaccgcccccaggugaccuucagcgagaaccuguccagcacaugccacacgaaggagcggcugccgucccacagcgacuuccucgcggagcugcgcaaggcccccguggucaacugcuccaucgccgugugccagcggauccagugcgacauccccuucuucgggauccaggaggaguucaacgccacccugaagggcaaccucagcuucgacugguacaucaagaccucccacaaccaccuccugaucgugagcaccgccgagauccucuucaacgacuccgucuucacgcugcugcccggccagggggcguucgugcgcagccagaccgagaccaagguggagccguucgagguccccaacccccucccccugaucgugggcuccagcguggggggccugcuccugcuggcccucaucaccgccgcccuguacaagcugggguucuucaagcggcaguacaaggacaugauguccgagggcggcccgcccggggccgagccccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3976 - RNA, 1751 nt, Artificial Sequence
  mRNA product Design3 comprising derived and/or modified sequence from Homo sapiens__NP_002415.1__HsMMP8 (opt1)
gggagagucccgcagucggcguccagcggcucugcuuguucgugugugugucguugcaggccuuauucaagcuuaccauguucagccugaagacccuccccuuccugcugcuccugcacgugcagaucuccaaggccuucccggucagcuccaaggagaagaacaccaagacggugcaggacuaccuggagaaguucuaccagcuccccagcaaccaguaccaguccacccgcaagaacggcaccaacgugaucgucgagaagcugaaggagaugcagcgguucuucgggcugaacgugaccggcaagcccaacgaggagacgcucgacaugaugaagaagccccgcugcggggugccggacagcggcggguucaugcugacccccggcaaccccaagugggagcggaccaaccugaccuaccgcauccggaacuacacgccccagcucuccgaggccgaggucgagcgcgcgaucaaggacgccuucgagcuguggagcguggccuccccgcugaucuucacccggaucagccagggcgaggccgacaucaacaucgccuucuaccagcgcgaccacggggacaacucccccuucgacggccccaacgggauccucgcgcacgccuuccagcccggccaggggaucggcggcgacgcccacuucgacgccgaggagaccuggaccaacacgagcgcgaacuacaaccuguuccugguggccgcccacgaguucgggcacucccucggccuggcccacagcuccgacccgggggcccugauguaccccaacuacgcguuccgggagaccagcaacuacucccucccccaggacgacaucgacggcauccaggccaucuacggccugagcuccaaccccauccagccgaccgggcccagcacccccaagcccugcgacccgagccugacguucgacgccaucaccacccuccgcggcgagauccuguucuucaaggaccgguacuucuggcgccggcacccccagcugcagcgcgucgagaugaacuucaucucccucuucuggcccagccugcccaccgggauccaggccgccuacgaggacuucgaccgggaccugaucuuccucuucaagggcaaccaguacugggcgcuguccggguacgacauccugcagggcuacccgaaggacaucagcaacuacggcuuccccuccagcgugcaggccaucgacgccgccguguucuaccgcuccaagacguacuucuucgucaacgaccaguucuggcgguacgacaaccagcgccaguucauggagcccggguaccccaagagcaucuccggcgccuucccggggaucgagagcaagguggacgcgguguuccagcaggagcacuucuuccacgucuucuccggcccccgguacuacgccuucgaccucaucgcccagcgcgugacccggguggcccgcgggaacaaguggcugaacugccgcuacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3977 - RNA, 2471 nt, Artificial Sequence
  mRNA product Design3 comprising derived and/or modified sequence from Homo sapiens__NP_004985.2__HsMMP9 (opt1)
gggagagucccgcagucggcguccagcggcucugcuuguucgugugugugucguugcaggccuuauucaagcuuaccaugagccuguggcagccccucgugcugguccugcucgugcugggcugcugcuucgccgccccgcgccagcggcaguccacccugguccucuuccccggggaccugcgcaccaaccugacggaccggcagcucgcggaggaguaccuguaccgcuacggcuacacccggguggccgagaugcgcggggagagcaagucccugggccccgcccuccugcugcuccagaagcagcugagccugcccgagaccggggagcucgacuccgccacccugaaggccaugcggacgccgcgcugcggcgugcccgaccugggccgguuccagaccuucgagggggaccucaaguggcaccaccacaacaucaccuacuggauccagaacuacagcgaggaccugccccgcgcggugaucgacgacgccuucgcccgggccuucgcgcugugguccgccgucacgccccucaccuucacccgcguguacagccgggacgccgacaucgugauccaguucggcgucgccgagcacggggacggcuacccguucgacgggaaggacggccugcuggcccacgcguucccgcccggccccgggauccagggcgacgcccacuucgacgacgacgagcucuggucccuggggaagggcguggugguccccacccgcuucggcaacgccgacggggccgccugccacuuccccuucaucuucgagggccggagcuacuccgcgugcaccacggacgggcgcagcgacggccugcccuggugcuccaccaccgccaacuacgacaccgacgaccgguucggguucugccccagcgagcgccucuacacgcaggacggcaacgccgacggcaagccgugccaguuccccuucaucuuccaggggcaguccuacagcgccugcaccaccgacggccgguccgacggguaccgcuggugcgccaccacggcgaacuacgaccgggacaagcuguucggcuucugccccacccgcgccgacagcaccgugaugggcggcaacuccgccggcgagcugugcguguuccccuucaccuuccucgggaaggaguacagcacgugcaccagcgagggccgcggggacggccggcuguggugcgccaccaccuccaacuucgacagcgacaagaaguggggguucugcccggaccagggcuacucccuguuccucgucgccgcgcacgaguucggccacgcccuggggcuggaccacagcuccgugcccgaggcccucauguaccccauguaccgcuucacggaggggcccccgcugcacaaggacgacgugaacgggauccggcaccuguacggcccccgccccgagcccgagccgcggccgcccaccaccaccacgccccagcccaccgccccgcccaccgucugccccaccggcccgcccacggugcaccccagcgagcgccccaccgcggggcccaccggcccgcccuccgccgggcccaccggcccgcccaccgccgggcccagcacggccaccaccgugccccucucccccgucgacgacgccugcaacgugaacaucuucgacgcgaucgccgagaucggcaaccagcuguaccuguucaaggacggcaaguacuggcgguucagcgaggggcgcggcucccggccccaggggcccuuccucaucgccgacaaguggccggcccugccccgcaagcuggacagcguguucgaggagcggcucuccaagaagcuguucuucuucagcggccgccaggucuggguguacaccggggccuccguccugggcccccggcgccuggacaagcucggccugggggcggacguggcccaggugacgggcgcccugcggagcgggcgcggcaagaugcuccuguucuccgggcggcgccuguggcgguucgacgucaaggcccagaugguggacccccgcagcgccuccgagguggaccgcauguucccgggcgucccccucgacacccacgacguguuccaguaccgggagaaggcguacuucugccaggaccgcuucuacuggcgggugagcagccgcuccgagcugaaccaggucgaccaggugggcuacgugaccuacgacauccugcagugccccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3978 - RNA, 1763 nt, Artificial Sequence
  mRNA product Design3 comprising derived and/or modified sequence from Homo sapiens__NP_002418.1__HsMMP13 (opt1)
gggagagucccgcagucggcguccagcggcucugcuuguucgugugugugucguugcaggccuuauucaagcuuaccaugcaccccggcgugcuggccgccuuccucuuccugagcuggacccacugccgcgcgcugccgcuccccuccgggggcgacgaggacgaccugagcgaggaggaccugcaguucgccgagcgguaccuccgcuccuacuaccaccccaccaaccuggccgggauccugaaggagaacgccgccagcuccaugacggagcggcuccgcgagaugcagagcuucuucggccuggaggucaccgggaagcuggacgacaacacccucgacgugaugaagaagccccggugcggcgugccggacgucggcgaguacaacguguucccccgcacccugaagugguccaagaugaaccugacguaccggaucgugaacuacacccccgacaugacccacagcgaggucgagaaggcguucaagaaggccuucaaggugugguccgacgugacgccccucaacuucacccgccugcacgacgggaucgccgacaucaugaucagcuucggcaucaaggagcacggggacuucuacccguucgacggccccuccgggcugcucgcccacgcguucccgcccggccccaacuacggcggggacgcccacuucgacgacgacgagaccuggaccagcuccagcaagggcuacaaccuguuccuggucgccgcccacgaguucgggcacucccucggccuggaccacagcaaggaccccggcgcccugauguuccccaucuacaccuacacggggaagucccacuucaugcuccccgacgacgacgugcagggcauccagagccuguacgggccgggcgacgaggaccccaaccccaagcaccccaagaccccggacaagugcgaccccucccugagccucgacgcgaucaccagccugcgcggggagaccaugaucuucaaggaccgguucuucuggcggcugcacccccagcaggucgacgccgagcuguuccugacgaaguccuucuggcccgagcugccgaaccgcaucgacgccgccuacgagcaccccagccacgaccucaucuucaucuuccggggccgcaaguucugggcccugaacggcuacgacauccuggagggguaccccaagaagaucuccgagcucggccugcccaaggaggugaagaagaucagcgcggccgugcacuucgaggacaccgggaagacccuccucuucuccggcaaccagguguggcgguacgacgacaccaaccacaucauggacaaggacuacccgcgccugaucgaggaggacuuccccgggaucggcgacaaggucgacgccguguacgagaagaacggcuacaucuacuucuucaacgggcccauccaguucgaguacagcaucugguccaaccggaucgugcgcgucaugccggccaacagcauccuguggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3979 - RNA, 1415 nt, Artificial Sequence
  mRNA product Design3 comprising derived and/or modified sequence from Homo sapiens__NP_001286.1__HsCCR1 (opt1)
gggagagucccgcagucggcguccagcggcucugcuuguucgugugugugucguugcaggccuuauucaagcuuaccauggagacccccaacaccacggaggacuacgacaccaccaccgaguucgacuacggcgacgccacgccgugccagaaggugaacgagcgcgccuucggggcgcagcugcucccgccccuguacagccuggucuucgugaucggccucguggggaacauccuggucgugcuggugcucguccaguacaagcggcugaagaacaugaccuccaucuaccugcucaaccuggccaucagcgaccuccucuuccuguucacccugcccuucuggaucgacuacaagcucaaggacgacuggguguucggcgacgccaugugcaagauccuguccggguucuacuacaccggccuguacagcgagaucuucuucaucauccuccugacgaucgaccgcuaccuggccaucgugcacgccgucuucgcgcuccgggcccgcaccgugaccuucggcgugaucaccuccaucaucaucugggcccuggccauccuggcgagcaugcccgggcucuacuucuccaagacgcagugggaguucacccaccacacgugcagccugcacuucccccacgagucccugcgggaguggaagcuguuccaggcccugaagcugaaccucuucggccugguccugccccuccuggugaugaucaucugcuacaccgggaucaucaagauccugcuccgccggcccaacgagaagaaguccaaggccgugcgccugaucuucgucaucaugaucaucuucuuccuguucuggaccccguacaaccucaccauccugaucagcguguuccaggacuuccuguucacccacgagugcgagcagagccggcaccucgaccuggccgugcaggucaccgaggugaucgccuacacgcacugcugcgugaaccccgucaucuacgcguucgugggcgagcgcuuccggaaguaccugcgccagcuguuccaccggcgcguggccguccaccucgugaaguggcugcccuuccucuccgucgaccggcuggagcgcgugagcuccaccagccccuccaccggggagcacgagcugagcgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3980 - RNA, 983 nt, Artificial Sequence
  mRNA product Design3 comprising derived and/or modified sequence from Homo sapiens__NP_002598.4__HsPDGFA (opt1)
gggagagucccgcagucggcguccagcggcucugcuuguucgugugugugucguugcaggccuuauucaagcuuaccaugcgcacccuggccugccuccugcugcucggcugcggguaccuggcccacgugcuggcggaggaggccgagaucccccgggaggugaucgagcgccucgcccggagccagauccacuccauccgcgaccugcagcggcugcucgagaucgacagcgugggcuccgaggacagccuggacaccucccugcgcgcccacggggugcacgccacgaagcacgucccggagaagcggccccuccccauccgccggaagcgcagcaucgaggaggcggugcccgccgugugcaagacccggaccgucaucuacgagaucccgcgcucccagguggaccccaccagcgccaacuuccugaucuggccgcccugcguggaggucaagcggugcacgggcugcugcaacaccuccagcgugaagugccagcccucccgcgugcaccaccggagcgucaagguggccaagguggaguacguccgcaagaagcccaagcugaaggagguccaggugcggcucgaggagcaccuggagugcgcgugcgccaccaccucccugaaccccgacuaccgcgaggaggacacggggcggccccgcgagagcggcaagaagcggaagcgcaagcgccucaagccgaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3981 - RNA, 1073 nt, Artificial Sequence
  mRNA product Design3 comprising derived and/or modified sequence from Homo sapiens__NP_002599.1__HsPDGFB (opt1)
gggagagucccgcagucggcguccagcggcucugcuuguucgugugugugucguugcaggccuuauucaagcuuaccaugaaccgcugcugggcccuguuccucagccugugcugcuaccugcggcucguguccgccgagggcgaccccaucccggaggagcuguacgagaugcugagcgaccacuccauccgcagcuucgacgaccuccagcggcugcugcacggggaccccggcgaggaggacggggcggagcucgaccugaacaugacccgcucccacagcggcggggagcuggagucccucgcccggggccgccggagccugggcucccugaccaucgccgagcccgccaugaucgccgagugcaagacgcgcaccgaggucuucgagaucagccggcgccucaucgaccggaccaacgcgaacuuccugguguggcccccgugcguggagguccagcgcugcuccgggugcugcaacaaccggaacgugcagugccgccccacccaggugcagcugcggcccguccaggugcgcaagaucgagaucgugcggaagaagcccaucuucaagaaggccacggucacccucgaggaccaccuggccugcaagugcgagaccguggccgcggcccgcccggugacccggagccccggcgggucccaggagcagcgcgccaagacgccccagacccgggucaccauccgcaccgugcgcgugcggcggcccccgaagggcaagcaccgcaaguucaagcacacgcacgacaagaccgcccugaaggagacccucggggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3982 - RNA, 1385 nt, Artificial Sequence
  mRNA product Design3 comprising derived and/or modified sequence from Homo sapiens__NP_057289.1__HsPDGFC (opt1)
gggagagucccgcagucggcguccagcggcucugcuuguucgugugugugucguugcaggccuuauucaagcuuaccaugagccuguucggccuccugcugcucaccuccgcccuggccgggcagcgccagggcacccaggcggagagcaaccuguccagcaaguuccaguucuccagcaacaaggagcagaacggggugcaggacccccagcacgagcggaucaucacggucuccaccaacggcagcauccacuccccgcgcuucccccacaccuacccccggaacaccgugcucguguggcgccuggucgccguggaggagaacguguggauccagcugacguucgacgagcgguucgggcucgaggaccccgaggacgacaucugcaaguacgacuucgucgagguggaggagccgagcgacggcaccauccugggccgcuggugcggguccggcaccgugcccgggaagcagaucagcaagggcaaccagauccggauccgcuucgucuccgacgaguacuuccccagcgagcccggguucugcauccacuacaacaucgugaugccgcaguucaccgaggccgugucccccagcguccugccgcccuccgcccucccccuggaccugcucaacaacgccaucacggcguucagcacccuggaggaccugauccgguaccucgagcccgagcgcuggcagcuggaccuggaggaccucuaccggcccaccuggcagcugcugggcaaggccuucguguucggccgcaagucccggguggucgaccucaaccugcugaccgaggaggugcgccucuacagcugcacgccccggaacuucagcguguccauccgcgaggagcugaagcggaccgacaccaucuucuggccggggugccugcucgucaagcgcugcggcgggaacugcgccugcugccugcacaacugcaacgagugccagugcgugcccagcaaggugaccaagaaguaccacgagguccugcagcuccggcccaagacgggcgugcgcggccugcacaagucccugaccgacguggcccucgagcaccacgaggagugcgacugcgucugccgggggagcaccggcgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3983 - RNA, 1442 nt, Artificial Sequence
  mRNA product Design3 comprising derived and/or modified sequence from Homo sapiens__NP_149126.1__HsPDGFD (opt1)
gggagagucccgcagucggcguccagcggcucugcuuguucgugugugugucguugcaggccuuauucaagcuuaccaugcaccgccugaucuucguguacacccucaucugcgccaacuucugcagcugccgggacaccuccgccacgccccagagcgcguccaucaaggcccugcgcaacgccaaccugcggcgcgacgaccucuaccggcgcgacgagaccauccaggucaagggcaacggguacgugcagagcccccgguuccccaacuccuacccccgcaaccugcugcucaccuggcggcugcacagccaggagaacacccgcauccagcugguguucgacaaccaguucggccucgaggaggccgagaacgacaucugccgguacgacuucgucgagguggaggacaucuccgagaccagcaccaucauccgcgggcgguggugcggccacaaggaggugcccccgcgcaucaagucccggaccaaccagaucaagaucaccuucaagagcgacgacuacuucgucgccaagcccggguucaagaucuacuacucccugcuggaggacuuccagcccgcggccgccagcgagacgaacugggaguccgugaccagcuccaucagcggcguguccuacaacagccccuccgucaccgacccgacccucaucgccgacgcgcuggacaagaagaucgccgaguucgacacgguggaggaccugcucaaguacuucaaccccgagagcuggcaggaggaccuggagaacauguaccuggacaccccgcgcuaccggggccgcagcuaccacgaccggaaguccaagguggaccucgaccgccugaacgacgacgccaagcgguacagcugcacgccccgcaacuacuccgucaacauccgcgaggagcugaagcucgccaacgugguguucuucccccggugccugcugguccagcgcugcgggggcaacugcgggugcggcaccgugaacuggcggagcugcacgugcaacuccgggaagaccgugaagaaguaccacgagguccuccaguucgagcccggccacaucaagcgccggggccgcgccaagaccauggcgcugguggacauccagcuggaccaccacgagcggugcgacugcaucugcagcucccgcccgccccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3984 - RNA, 1025 nt, Artificial Sequence
  mRNA product Design3 comprising derived and/or modified sequence from Homo sapiens__NP_003946.3__HsSOCS3 (opt1)
gggagagucccgcagucggcguccagcggcucugcuuguucgugugugugucguugcaggccuuauucaagcuuaccauggugacccacagcaaguuccccgccgccggcaugucccgcccgcuggacaccagccuccggcugaagacguucuccagcaaguccgaguaccagcuggucgugaacgcggugcgcaagcuccaggagagcggguucuacugguccgccgucaccggcggggaggccaaccugcugcucagcgccgagcccgccggcaccuuccugauccgggacuccagcgaccagcgccacuucuucacccuguccgugaagacgcagagcgggaccaagaaccuccggauccagugcgagggcggcuccuucagccugcaguccgacccccgcagcacccagcccgugccgcgguucgacugcguccugaagcucgugcaccacuacaugcccccgcccggggcgcccuccuuccccagcccgcccaccgagcccuccagcgaggugcccgagcagcccagcgcccagccccugccgggcuccccgccccgccgggccuacuacaucuacagcgggggcgagaagaucccccugguccucucccgcccccugagcuccaacguggccacgcugcagcaccucugccggaagaccgugaacgggcaccuggacagcuacgagaaggucacccagcugcccggccccauccgcgaguuccucgaccaguacgacgcgccccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3985 - RNA, 830 nt, Artificial Sequence
  mRNA product Design3 comprising derived and/or modified sequence from Homo sapiens__NP_003227.1__HsTGFA (opt1)
gggagagucccgcagucggcguccagcggcucugcuuguucgugugugugucguugcaggccuuauucaagcuuaccauggugcccagcgccggccagcuggcccucuucgcgcuggggaucguccuggccgccugccaggcccucgagaacuccaccagcccgcuguccgccgacccgcccguggcggccgccguggucagccacuucaacgacugccccgacucccacacccaguucugcuuccacggcacgugccgcuuccuggugcaggaggacaagcccgccugcgugugccacagcggguacgucggcgcgcggugcgagcacgccgaccuccuggccgugguggccgccucccagaagaagcaggcgaucaccgcccuggucguggugagcaucgucgcccucgccgugcugaucaucacgugcgugcugauccacugcugccagguccgcaagcacugcgaguggugccgggcccucaucugccgccacgagaagcccuccgcgcugcugaaggggcggaccgccugcugccacagcgagaccguggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3986 - RNA, 1520 nt, Artificial Sequence
  mRNA product Design3 comprising derived and/or modified sequence from Homo sapiens__NP_000651.3__HsTGFB1 (opt1)
gggagagucccgcagucggcguccagcggcucugcuuguucgugugugugucguugcaggccuuauucaagcuuaccaugcccccgagcggccugcgccuccugccccugcuccugccccugcucuggcugcuggugcucacccccgggcggccggccgccggccuguccacgugcaagaccaucgacauggagcuggucaagcgcaagcggaucgaggcgauccgcgggcagauccucagcaagcugcggcuggccuccccgcccagccagggcgaggugccgcccgggccccuccccgaggccgugcuggcccuguacaacuccacccgcgaccgggucgccggcgagagcgcggagcccgagcccgagcccgaggccgacuacuacgccaaggaggugacccgcgugcucauggucgagacccacaacgagaucuacgacaaguucaagcaguccacgcacagcaucuacauguucuucaacaccuccgagcugcgggaggccgugcccgagcccgugcugcucagccgcgcggagcugcggcugcuccgccugaagcugaaggucgagcagcacguggagcucuaccagaaguacuccaacaacagcuggcgguaccuguccaaccgccugcucgccccgagcgacucccccgaguggcugagcuucgacgugaccggcgucgugcggcaguggcugucccgcgggggcgagaucgagggguuccggcucagcgcccacugcuccugcgacagccgcgacaacacccuccagguggacaucaacggcuucacgaccgggcggcgcggcgaccuggccaccauccacggcaugaaccggcccuuccugcugcugauggccacgccccucgagcgcgcgcagcaccuccagagcucccgccaccggcgcgcccuggacaccaacuacugcuucagcuccaccgagaagaacugcugcguccggcagcuguacaucgacuuccgcaaggaccugggguggaaguggauccacgagccgaagggcuaccacgccaacuucugccuggggcccugccccuacaucuggagccucgacacccaguacuccaaggugcuggcccuguacaaccagcacaaccccggcgccagcgcggccccgugcugcgugccccaggcccucgagccccugcccaucgucuacuacgugggccggaagccgaagguggagcagcuguccaacaugaucguccgcagcugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3987 - RNA, 1592 nt, Artificial Sequence
  mRNA product Design3 comprising derived and/or modified sequence from Homo sapiens__NP_003229.1__HsTGFB2 (opt1)
gggagagucccgcagucggcguccagcggcucugcuuguucgugugugugucguugcaggccuuauucaagcuuaccaugcacuacugcgugcugagcgccuuccucauccugcaccuggucaccguggcccucucccugagcacgugcuccacccuggacauggaccaguucaugcgcaagcggaucgaggcgauccgcggccagauccucagcaagcugaagcugaccagcccgcccgaggacuaccccgagcccgaggaggugcccccggaggucaucuccaucuacaacuccacccgggaccuccugcaggagaaggccagccgccgggccgccgccugcgagcgcgagcgguccgacgaggaguacuacgcgaaggagguguacaagaucgacaugccgcccuucuuccccagcgagaacgccaucccgcccaccuucuaccgccccuacuuccggaucgugcgcuucgacgucuccgccauggagaagaacgccagcaaccuggugaaggcggaguuccggguguuccgccuccagaaccccaaggcccggguccccgagcagcgcaucgagcuguaccagauccugaaguccaaggaccucacgagccccacccagcgguacaucgacuccaagguggugaagacccgcgccgagggggaguggcugagcuucgacgucaccgacgccgugcacgaguggcugcaccacaaggaccggaaccucggcuucaagaucucccugcacugccccugcugcacguucgugcccagcaacaacuacaucaucccgaacaaguccgaggagcuggaggcccgcuucgcggggaucgacggcaccagcaccuacaccagcggggaccagaagacgaucaaguccacccggaagaagaacagcggcaagacgccccaccuccugcugaugcuccugcccuccuaccgccuggagagccagcagaccaaccggcgcaagaagcgcgcccucgacgccgccuacugcuuccggaacguccaggacaacugcugccugcgcccccuguacaucgacuucaagcgggaccucggcuggaaguggauccacgagccgaagggguacaacgccaacuucugcgcgggcgccugccccuaccugugguccagcgacacccagcacucccgcgugcugagccucuacaacaccaucaaccccgaggccuccgccagccccugcugcgugucccaggaccuggagccgcugaccauccucuacuacaucgggaagacccccaagaucgagcagcugagcaacaugaucgucaaguccugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3988 - RNA, 1586 nt, Artificial Sequence
  mRNA product Design3 comprising derived and/or modified sequence from Homo sapiens__NP_003230.1__HsTGFB3 (opt1)
gggagagucccgcagucggcguccagcggcucugcuuguucgugugugugucguugcaggccuuauucaagcuuaccaugaagaugcaccuccagcgcgcccucguggugcuggcccugcucaacuucgcgaccgugagccugucccugagcacgugcaccacccucgacuucggccacaucaagaagaagcggguggaggccauccgcgggcagauccuguccaagcugcggcucaccagcccgcccgagcccaccgucaugacgcacgugcccuaccaggugcuggcccuguacaacuccacccgcgagcuccuggaggagaugcacggcgagcgggaggaggggugcacccaggagaacaccgagagcgaguacuacgccaaggagauccacaaguucgacaugauccagggccuggccgagcacaacgagcucgcggucugccccaaggggaucacguccaagguguuccgcuucaacgugagcuccgucgagaagaaccggaccaaccuguuccgcgccgaguuccgggugcugcgcgugccgaaccccagcuccaagcggaacgagcagcgcaucgagcuguuccagauccugcggcccgacgagcacaucgccaagcagcgcuacaucggcggcaagaaccugcccacccgggggaccgccgaguggcucagcuucgacgucacggacaccgugcgcgaguggcugcugcggcgcgaguccaaccucggccuggagaucagcauccacugcccgugccacaccuuccagcccaacggggacauccuggagaacauccacgaggugauggagaucaaguucaagggcgucgacaacgaggacgaccacgggcggggcgaccucggccgccugaagaagcagaaggaccaccacaacccccaccugauccucaugaugaucccgccccaccggcuggacaaccccgggcagggcgggcagcgcaagaagcgcgcgcuggacaccaacuacugcuuccggaaccucgaggagaacugcugcgugcgcccccuguacaucgacuuccggcaggaccugggcuggaagugggugcacgagcccaagggcuacuacgccaacuucugcuccgggccgugccccuaccuccgcagcgccgacacgacccacuccaccguccugggccuguacaacacccucaaccccgaggccagcgccucccccugcugcgugccgcaggaccuggagccccugacgauccucuacuacguggggcggacccccaaggucgagcagcugagcaacaugguggucaagagcugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3989 - RNA, 1733 nt, Artificial Sequence
  mRNA product Design3 comprising derived and/or modified sequence from Homo sapiens__NP_001057.1__HsTNFRSF1B (opt1)
gggagagucccgcagucggcguccagcggcucugcuuguucgugugugugucguugcaggccuuauucaagcuuaccauggcccccguggccgucugggcggcccuggccgugggccucgagcugugggccgccgcgcacgcccugccggcccagguggccuucacccccuacgcgcccgagcccgggagcacgugccgccuccgggaguacuacgaccagaccgcccagaugugcugcuccaagugcagcccgggccagcacgccaaggucuucugcaccaagaccuccgacaccgugugcgacagcugcgaggacuccacguacacccagcuguggaacugggugcccgagugccugagcugcgggucccgcugcagcuccgaccaggucgagacccaggccugcacccgggagcagaaccgcaucugcacgugccggcccggcugguacugcgcccucagcaagcaggaggggugccgccugugcgcgccccugcggaagugccgcccgggcuucggcguggcccggcccgggaccgagaccuccgacguggucugcaagcccugcgcccccggcaccuucagcaacacgaccuccagcaccgacaucugccgcccgcaccagaucugcaacgugguggccauccccgggaacgccuccauggacgcggucugcaccagcacgucccccacccggagcauggcccccggcgccgugcaccucccgcagcccguguccacccgcagccagcacacccagcccacgcccgagccgagcaccgcccccuccaccagcuuccugcugcccauggggcccuccccgcccgccgagggcagcaccggcgacuucgcgcuccccgucgggcugaucgugggcgugacggcccuggggcuccugaucaucggcgucgugaacugcgugaucaugacccaggucaagaagaagccccugugccuccagcgggaggccaaggugccgcaccuccccgccgacaaggcccgcggcacccaggggcccgagcagcagcaccuccugaucaccgcgccguccagcuccagcuccagccuggaguccagcgccuccgcccuggaccggcgcgcccccacgcggaaccagccccaggcgcccggcguggaggccagcggggccggcgaggcccgcgccuccaccgggagcuccgacagcuccccgggcggccacgggacccaggucaacgugaccugcaucgucaacgugugcagcagcuccgaccacagcucccagugcagcucccaggcgagcuccacgaugggcgacaccgacagcucccccagcgagucccccaaggacgagcagguccccuucagcaaggaggagugcgccuuccggucccagcuggagaccccggagacccugcuggggagcacggaggagaagccccucccccugggcgugcccgacgccgggaugaagccguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3990 - RNA, 860 nt, Artificial Sequence
  mRNA product Design3 comprising derived and/or modified sequence from Homo sapiens__NP_002623.2__HsPGF (opt1)
gggagagucccgcagucggcguccagcggcucugcuuguucgugugugugucguugcaggccuuauucaagcuuaccaugcccgugaugcgccuguucccgugcuuccuccagcugcuggccggccucgcccugcccgcggucccgccccagcagugggcccugagcgccgggaacggcuccagcgagguggaggugguccccuuccaggaggugugggggcgguccuacugccgcgcccucgagcggcugguggacgucgugagcgaguaccccuccgagguggagcacauguucagccccuccugcgucagccugcuccgcugcaccggcugcugcggggacgagaaccugcacugcgugcccguggagaccgccaacgucacgaugcagcugcucaagauccgguccggcgaccgcccgagcuacguggagcugaccuucucccagcacgugcggugcgagugccgcccccugcgggagaagaugaagcccgagcgccggcgccccaagggccgggggaagcgccggcgcgagaagcagcggccgaccgacugccaccucugcggcgacgcggucccccgccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3991 - RNA, 1586 nt, Artificial Sequence
  mRNA product Design3 comprising derived and/or modified sequence from Homo sapiens__NP_001020537.2__HsVEGFA (opt1)
gggagagucccgcagucggcguccagcggcucugcuuguucgugugugugucguugcaggccuuauucaagcuuaccaugaccgaccgccagaccgacacggcccccagcccguccuaccaccuccugcccggccggcgccggaccguggacgccgcggccagccgcgggcagggccccgagcccgcccccgggggcggggucgagggcgugggcgcccgcgggguggcccugaagcuguucguccagcuccugggcugcucccgguucgggggcgcgguggugcgggccggggaggccgagcccagcggcgccgcgcgcuccgccagcuccggccgggaggagccccagcccgaggagggggaggaggaggaggagaaggaggaggagcgcggcccgcaguggcggcugggggcccgcaagcccggcagcuggaccggcgaggccgccgucugcgcggacuccgcccccgccgcccgggccccgcaggcgcucgcccgcgccagcgggcggggcgggcgcguggcccggcgcggcgccgaggaguccgggccgccccacagccccucccggcgcggcagcgcgucccgggccggccccgggcgcgccagcgagaccaugaacuuccugcuguccugggugcacuggagccucgcccugcugcucuaccugcaccacgccaaguggucccaggcggccccgauggccgagggcgggggccagaaccaccacgaggucgugaaguucauggacguguaccagcgcagcuacugccaccccaucgagacgcuggucgacaucuuccaggaguaccccgacgagaucgaguacaucuucaagcccagcugcgugccgcucaugcggugcgggggcugcugcaacgacgagggccuggagugcgugcccaccgaggaguccaacaucaccaugcagaucaugcgcaucaagccccaccaggggcagcacaucggcgagaugagcuuccugcagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcgcgcugcugccucaugccguggucccugcccggcccccaccccugcgggccgugcagcgagcggcgcaagcaccuguucguccaggacccccagaccugcaagugcuccugcaagaacacggacagccggugcaaggcccgccagcucgagcugaacgagcggaccugccgcugcgacaagccccggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3992 - RNA, 1046 nt, Artificial Sequence
  mRNA product Design3 comprising derived and/or modified sequence from Homo sapiens__NP_001165094.1__HsVEGFA (opt1)
gggagagucccgcagucggcguccagcggcucugcuuguucgugugugugucguugcaggccuuauucaagcuuaccaugaacuuccugcucagcugggugcacuggucccuggcccugcuccuguaccugcaccacgccaaguggagccaggcggcccccauggccgagggcgggggccagaaccaccacgaggucgugaaguucauggacguguaccagcgcuccuacugccacccgaucgagacccucgucgacaucuuccaggaguaccccgacgagaucgaguacaucuucaagcccagcugcgugccccugaugcggugcgggggcugcugcaacgacgaggggcuggagugcgugccgaccgaggaguccaacaucacgaugcagaucaugcgcaucaagccccaccagggccagcacaucggcgagaugagcuuccuccagcacaacaagugcgagugccggcccaagaaggaccgcgcccggcaggagaagaaguccguccgcgggaagggcaaggggcagaagcggaagcgcaagaagucccgguacaagagcuggagcguguacgugggcgcccgcugcugccugaugcccuggucccugccggggccccaccccugcggccccugcagcgagcggcgcaagcaccucuucguccaggacccgcagaccugcaagugcuccugcaagaacaccgacagccggugcaaggcgcgccagcuggagcugaacgagcggaccugccgcugcgacaagccccggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3993 - RNA, 971 nt, Artificial Sequence
  mRNA product Design3 comprising derived and/or modified sequence from Homo sapiens__NP_003368.1__HsVEGFB (opt1)
gggagagucccgcagucggcguccagcggcucugcuuguucgugugugugucguugcaggccuuauucaagcuuaccaugagcccccugcuccgccggcugcugcucgccgcccugcugcagcucgcgccggcccaggcccccgugucccagcccgacgcccccggccaccagcgcaaggucgugagcuggaucgacguguacacccgggcgaccugccagccgcgcgaggucguggugccccugacggucgagcugauggggaccguggccaagcagcucgugcccuccugcgucaccgugcagcggugcggcgggugcugccccgacgacggccuggagugcgugccgaccgggcagcaccagguccgcaugcagauccugaugauccgguaccccagcucccagcucggcgagaugagccuggaggagcacucccagugcgagugccgccccaagaagaaggacagcgccgugaagcccgaccgggccgccacgccgcaccaccgcccccagccccgguccgugcccggcugggacagcgcgccgggggcccccucccccgccgacaucacccaccccaccccggcccccggccccagcgcccacgcggcccccuccaccacgagcgcccugaccccggggcccgccgccgcggccgccgacgccgccgcguccagcgucgccaagggcggggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3994 - RNA, 1607 nt, Artificial Sequence
  mRNA product Design3 comprising derived and/or modified sequence from Homo sapiens__NP_005420.1__HsVEGFC (opt1)
gggagagucccgcagucggcguccagcggcucugcuuguucgugugugugucguugcaggccuuauucaagcuuaccaugcaccuccugggcuucuucagcguggccugcucccugcuggccgcggcccuccugcccgggccgcgcgaggcccccgccgccgcggccgccuucgagagcggccuggaccucuccgacgccgagcccgacgcgggggaggccaccgccuacgccagcaaggaccuggaggagcagcugcgguccgucagcuccguggacgagcucaugaccgugcuguaccccgaguacuggaagauguacaagugccagcugcgcaagggcggguggcagcacaaccgggagcaggccaaccucaacagccgcacggaggagaccaucaaguucgcggccgcccacuacaacaccgagauccugaaguccaucgacaacgaguggcggaagacccagugcaugccgcgcgaggucugcaucgacgugggcaaggaguucggcguggccacgaacaccuucuucaagccgcccugcgucagcguguaccggugcgggggcugcugcaacuccgaggggcugcagugcaugaacaccagcaccuccuaccucagcaagacgcuguucgagaucaccgugccccugucccagggccccaagcccgucaccaucagcuucgccaaccacaccuccugccgcugcaugagcaagcucgacguguaccgccaggugcacuccaucauccggcggagccugcccgcgacgcugccccagugccaggccgccaacaagaccugcccgaccaacuacauguggaacaaccacaucugccgcugccucgcccaggaggacuucauguucagcuccgacgccggggacgacagcaccgacggcuuccacgacaucugcggccccaacaaggagcuggacgaggagacgugccagugcgucugccgggcggggcugcgccccgccuccugcggcccccacaaggagcucgaccggaacagcugccagugcgugugcaagaacaagcuguucccgucccagugcggggccaaccgcgaguucgacgagaacacgugccagugcgugugcaagcggaccugcccccgcaaccagccccugaaccccggcaagugcgccugcgagugcaccgagagcccgcagaagugccuccugaagggcaagaaguuccaccaccagaccugcuccugcuaccggcgccccugcaccaaccggcagaaggccugcgagcccggguucagcuacuccgaggaggucugccgcugcgugcccagcuacuggaagcgcccgcagauguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3995 - RNA, 1412 nt, Artificial Sequence
  mRNA product Design3 comprising derived and/or modified sequence from Homo sapiens__NP_004460.1__HsVEGFD (opt1)
gggagagucccgcagucggcguccagcggcucugcuuguucgugugugugucguugcaggccuuauucaagcuuaccauguaccgcgaguggguggucgugaacguguucaugaugcuguacguccagcucgugcagggcagcuccaacgagcacgggcccgugaagcggagcucccagagcacccuggagcgcuccgagcagcagauccgggccgccagcucccuggaggagcuccugcgcaucacccacagcgaggacuggaagcuguggcggugccgccuccggcugaaguccuucacgagcauggacucccgcagcgcgucccaccggagcacccgcuucgccgccaccuucuacgacaucgagacccugaaggucaucgacgaggaguggcagcggacgcagugcuccccgcgcgagaccugcguggagguggccagcgagcucggcaaguccaccaacaccuucuucaagccgcccugcgucaacguguuccggugcgggggcugcugcaacgaggagagccugaucugcaugaacacguccaccagcuacaucagcaagcagcuguucgagaucuccgugccccucaccagcguccccgagcuggugcccgugaaggucgccaaccacaccgggugcaagugccugcccacggcgccccgccacccguacuccaucauccggcgcagcauccagauccccgaggaggaccggugcucccacagcaagaagcucugccccaucgacaugcugugggacuccaacaagugcaagugcgugcugcaggaggagaacccccucgccggcaccgaggaccacagccaccuccaggagccggcccugugcggcccccacaugauguucgacgaggaccgcugcgagugcgugugcaagacccccugccccaaggaccugauccagcacccgaagaacugcuccugcuucgagugcaaggagagccuggagaccugcugccagaagcacaagcuguuccaccccgacacgugcuccugcgaggaccggugccccuuccacacccgccccugcgccagcgggaagaccgcgugcgccaagcacugccgguucccgaaggagaagcgcgccgcccagggcccccacucccgcaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3996 - RNA, 977 nt, Artificial Sequence
  mRNA product Design3 comprising derived and/or modified sequence from Homo sapiens__NP_061986.1__HsFGF21 (opt2)
gggagagucccgcagucggcguccagcggcucugcuuguucgugugugugucguugcaggccuuauucaagcuuaccauggacuccgacgagaccggcuucgagcacuccggccucugggucuccguccucgccggccuccuccucggcgccugccaggcccaccccauccccgacuccuccccccuccuccaguucggcggccagguccgccagcgcuaccucuacaccgacgacgcccagcagaccgaggcccaccucgagauccgcgaggacggcaccgucggcggcgccgccgaccagucccccgagucccuccuccagcucaaggcccucaagcccggcgucauccagauccucggcgucaagaccucccgcuuccucugccagcgccccgacggcgcccucuacggcucccuccacuucgaccccgaggccugcuccuuccgcgagcuccuccucgaggacggcuacaacgucuaccaguccgaggcccacggccucccccuccaccuccccggcaacaaguccccccaccgcgaccccgccccccgcggccccgcccgcuuccucccccuccccggccucccccccgcccuccccgagccccccggcauccucgccccccagccccccgacgucggcuccuccgacccccucuccauggucggccccucccagggccgcucccccuccuacgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3997 - RNA, 1757 nt, Artificial Sequence
  mRNA product Design3 comprising derived and/or modified sequence from Homo sapiens__NP_002412.1__HsMMP1 (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuuccccgccacccucgagacccaggagcaggacgucgaccucguccagaaguaccucgagaaguacuacaaccucaagaacgacggccgccaggucgagaagcgccgcaacuccggccccgucgucgagaagcucaagcagaugcaggaguucuucggccucaaggucaccggcaagcccgacgccgagacccucaaggucaugaagcagccccgcugcggcguccccgacgucgcccaguucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3998 - RNA, 1517 nt, Artificial Sequence
  mRNA product Design3 comprising derived and/or modified sequence from Homo sapiens__NP_002412.1__HsMMP1(1-19,100-469) (opt2)
gggagagucccgcagucggcguccagcggcucugcuuguucgugugugugucguugcaggccuuauucaagcuuaccaugcacuccuuccccccccuccuccuccuccucuucuggggcgucgucucccacuccuucguccucaccgagggcaacccccgcugggagcagacccaccucaccuaccgcaucgagaacuacacccccgaccucccccgcgccgacgucgaccacgccaucgagaaggccuuccagcucugguccaacgucaccccccucaccuucaccaaggucuccgagggccaggccgacaucaugaucuccuucguccgcggcgaccaccgcgacaacucccccuucgacggccccggcggcaaccucgcccacgccuuccagcccggccccggcaucggcggcgacgcccacuucgacgaggacgagcgcuggaccaacaacuuccgcgaguacaaccuccaccgcgucgccgcccacgagcucggccacucccucggccucucccacuccaccgacaucggcgcccucauguaccccuccuacaccuucuccggcgacguccagcucgcccaggacgacaucgacggcauccaggccaucuacggccgcucccagaaccccguccagcccaucggcccccagacccccaaggccugcgacuccaagcucaccuucgacgccaucaccaccauccgcggcgaggucauguucuucaaggaccgcuucuacaugcgcaccaaccccuucuaccccgaggucgagcucaacuucaucuccgucuucuggccccagcuccccaacggccucgaggccgccuacgaguucgccgaccgcgacgagguccgcuucuucaagggcaacaaguacugggccguccagggccagaacguccuccacggcuaccccaaggacaucuacuccuccuucggcuucccccgcaccgucaagcacaucgacgccgcccucuccgaggagaacaccggcaagaccuacuucuucgucgccaacaaguacuggcgcuacgacgaguacaagcgcuccauggaccccggcuaccccaagaugaucgcccacgacuuccccggcaucggccacaaggucgacgccgucuucaugaaggacggcuucuucuacuucuuccacggcacccgccaguacaaguucgaccccaagaccaagcgcauccucacccuccagaaggccaacuccugguucaacugccgcaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 3999 - RNA, 3704 nt, Artificial Sequence
  mRNA product Design3 comprising derived and/or modified sequence from Clostridium histolyticum__BAA77453.1__ColG (opt2)
gggagagucccgcagucggcguccagcggcucugcuuguucgugugugugucguugcaggccuuauucaagcuuaccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4000 - RNA, 3428 nt, Artificial Sequence
  mRNA product Design3 comprising derived and/or modified sequence from Clostridium histolyticum__BAA77453.1__HsALB(1-18)_ColG(111-1118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4001 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4002 - RNA, 3452 nt, Artificial Sequence
  mRNA product Design3 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaacuuccucaagaucauccucaaccgcggcaagaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4003 - RNA, 3413 nt, Artificial Sequence
  mRNA product Design3 comprising derived and/or modified sequence from Clostridium histolyticum__BAA34542.1__ColH (opt2)
gggagagucccgcagucggcguccagcggcucugcuuguucgugugugugucguugcaggccuuauucaagcuuaccaugaagcgcaagugccucuccaagcgccucaugcucgccaucaccauggccaccaucuucaccgucaacuccacccuccccaucuacgccgccgucgacaagaacaacgccaccgccgccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4004 - RNA, 3347 nt, Artificial Sequence
  mRNA product Design3 comprising derived and/or modified sequence from Clostridium histolyticum__BAA34542.1__HsALB(1-18)_ColH(41-1021) (opt2)
gggagagucccgcagucggcguccagcggcucugcuuguucgugugugugucguugcaggccuuauucaagcuuaccaugaagugggucaccuucaucucccuccucuuccucuucuccuccgccuacuccguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4005 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt2)
gggagagucccgcagucggcguccagcggcucugcuuguucgugugugugucguugcaggccuuauucaagcuuaccaugaagugggucaccuucaucucccuccucuuccucuucuccuccgccuacuccaugaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4006 - RNA, 923 nt, Artificial Sequence
  mRNA product Design3 comprising derived and/or modified sequence from Homo sapiens__NP_001133.1__HsAMELX (opt2)
gggagagucccgcagucggcguccagcggcucugcuuguucgugugugugucguugcaggccuuauucaagcuuaccaugggcaccuggauccucuucgccugccuccucggcgccgccuucgccaugccccuccccccccaccccggccaccccggcuacaucaacuucuccuacgagguccucaccccccucaagugguaccaguccauccgcccccccuaccccuccuacggcuacgagcccaugggcggcuggcuccaccaccagaucauccccguccucucccagcagcacccccccacccacacccuccagccccaccaccacauccccgucguccccgcccagcagcccgucaucccccagcagcccaugaugcccguccccggccagcacuccaugacccccauccagcaccaccagcccaaccuccccccccccgcccagcagcccuaccagccccagcccguccagccccagccccaccagcccaugcagccccagccccccguccaccccaugcagccccuccccccccagcccccccucccccccauguuccccaugcagccccucccccccaugcuccccgaccucacccucgaggccuggcccuccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4007 - RNA, 482 nt, Artificial Sequence
  mRNA product Design3 comprising derived and/or modified sequence from Homo sapiens__NP_001133.1__HsAMELX-TRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccauccgcccccccuaccccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4008 - RNA, 515 nt, Artificial Sequence
  mRNA product Design3 comprising derived and/or modified sequence from Homo sapiens__NP_001133.1__HsAMELX-LRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4009 - RNA, 554 nt, Artificial Sequence
  mRNA product Design3 comprising derived and/or modified sequence from Homo sapiens__NP_001133.1__HLA-A2-SP_HsAMELX(17-60) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgcccccccuaccccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4010 - RNA, 587 nt, Artificial Sequence
  mRNA product Design3 comprising derived and/or modified sequence from Homo sapiens__NP_001133.1__HLA-A2-SP_HsAMELX(17-47,168-191) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccauccgccccccccccaugcuccccgaccucacccucgaggccuggcccuccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4011 - RNA, 926 nt, Artificial Sequence
  mRNA product Design3 comprising derived and/or modified sequence from Homo sapiens__NP_001134.1__HsAMELY (opt2)
gggagagucccgcagucggcguccagcggcucugcuuguucgugugugugucguugcaggccuuauucaagcuuaccaugggcaccuggauccucuucgccugccucgucggcgccgccuucgccaugccccuccccccccaccccggccaccccggcuacaucaacuucuccuacgagguccucaccccccucaagugguaccaguccaugauccgcccccccuacuccuccuacggcuacgagcccaugggcggcuggcuccaccaccagaucauccccgucgucucccagcagcacccccucacccacacccuccagucccaccaccacauccccgucguccccgcccagcagccccgcguccgccagcaggcccucaugcccguccccggccagcaguccaugacccccacccagcaccaccagcccaaccucccccuccccgcccagcagcccuuccagccccagcccguccagccccagccccaccagcccaugcagccccagccccccguccagcccaugcagccccuccucccccagcccccccucccccccauguucccccuccgcccccucccccccauccuccccgaccuccaccucgaggccuggcccgccaccgacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4012 - RNA, 485 nt, Artificial Sequence
  mRNA product Design3 comprising derived and/or modified sequence from Homo sapiens__NP_001134.1__HsAMELY-TRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccaugauccgcccccccuacuccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4013 - RNA, 518 nt, Artificial Sequence
  mRNA product Design3 comprising derived and/or modified sequence from Homo sapiens__NP_001134.1__HsAMELY-LRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4014 - RNA, 557 nt, Artificial Sequence
  mRNA product Design3 comprising derived and/or modified sequence from Homo sapiens__NP_001134.1__HLA-A2-SP_HsAMELY(17-61) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgcccccccuacuccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4015 - RNA, 590 nt, Artificial Sequence
  mRNA product Design3 comprising derived and/or modified sequence from Homo sapiens__NP_001134.1__HLA-A2-SP_HsAMELY(17-48,169-192) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccaguccaugauccgccccccccccauccuccccgaccuccaccucgaggccuggcccgccaccgacaagaccaagcaggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4016 - RNA, 917 nt, Artificial Sequence
  mRNA product Design3 comprising derived and/or modified sequence from Sus scrofa__NP_999071.1__SsAMELX-001-1 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4017 - RNA, 485 nt, Artificial Sequence
  mRNA product Design3 comprising derived and/or modified sequence from Sus scrofa__NP_999071.1__SsAMELX-TRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4018 - RNA, 518 nt, Artificial Sequence
  mRNA product Design3 comprising derived and/or modified sequence from Sus scrofa__NP_999071.1__SsAMELX-LRAP (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4019 - RNA, 557 nt, Artificial Sequence
  mRNA product Design3 comprising derived and/or modified sequence from Sus scrofa__NP_999071.1__HLA-A2-SP_SsAMEL(17-61) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccuacaccuccuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4020 - RNA, 590 nt, Artificial Sequence
  mRNA product Design3 comprising derived and/or modified sequence from Sus scrofa__NP_999071.1__HLA-A2-SP_SsAMEL(17-49,167-189) (opt2)
gggagagucccgcagucggcguccagcggcucugcuuguucgugugugugucguugcaggccuuauucaagcuuaccauggccgucauggccccccgcacccucguccuccuccucuccggcgcccucgcccucacccagaccugggccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4021 - RNA, 881 nt, Artificial Sequence
  mRNA product Design3 comprising derived and/or modified sequence from Sus scrofa__P45561-2__SsAMELX-001-2 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4022 - RNA, 917 nt, Artificial Sequence
  mRNA product Design3 comprising derived and/or modified sequence from Sus scrofa__NP_998965.1__SsAMELX-001-3 (opt2)
gggagagucccgcagucggcguccagcggcucugcuuguucgugugugugucguugcaggccuuauucaagcuuaccaugggcaccuggaucuucuucgccugccuccucggcgccucccucgccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4023 - RNA, 566 nt, Artificial Sequence
  mRNA product Design3 comprising derived and/or modified sequence from Sus scrofa__K7GPB2__SsAMELX-002 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4024 - RNA, 959 nt, Artificial Sequence
  mRNA product Design3 comprising derived and/or modified sequence from Sus scrofa__K7GLD0__SsAMELX-003 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgaggaccucuaccucgaggccauccgcaucgaccgcaccgccuucguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4025 - RNA, 845 nt, Artificial Sequence
  mRNA product Design3 comprising derived and/or modified sequence from Sus scrofa__K7GPE9__SsAMELX-004 (opt2)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgagguccucaccccccucaagugguaccagaacaugauccgccaccccaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4026 - RNA, 869 nt, Artificial Sequence
  mRNA product Design3 comprising derived and/or modified sequence from Sus scrofa__J9JIM4__SsAMELX-201 (opt2)
gggagagucccgcagucggcguccagcggcucugcuuguucgugugugugucguugcaggccuuauucaagcuuaccaugccccuccccccccaccccggccaccccggcuacaucaacuucuccuacgagguccucaccccccucaagugguaccagaacaugauccgccaccccuacaccuccuacggcuacgagcccaugggcggcuggcuccaccaccagaucauccccgucgucucccagcagaccccccagucccacgcccuccagccccaccaccacauccccaugguccccgcccagcagcccggcaucccccagcagcccaugaugccccuccccggccagcacuccaugacccccacccagcaccaccagcccaaccucccccuccccgcccagcagcccuuccagccccagcccguccagccccagccccaccagccccuccagccccagucccccaugcaccccauccagccccuccucccccagcccccccucccccccauguucuccaugcagucccuccuccccgaccucccccucgaggccuggcccgccaccgacaagaccaagcgcgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4027 - RNA, 3308 nt, Artificial Sequence
  mRNA product Design3 comprising derived and/or modified sequence from Homo sapiens__NP_006120.1__HsBMP1 (opt2)
gggagagucccgcagucggcguccagcggcucugcuuguucgugugugugucguugcaggccuuauucaagcuuaccaugcccggcgucgcccgccucccccuccuccucggccuccuccuccucccccgccccggccgcccccucgaccucgccgacuacaccuacgaccucgccgaggaggacgacuccgagccccucaacuacaaggaccccugcaaggccgccgccuuccucggcgacaucgcccucgacgaggaggaccuccgcgccuuccagguccagcaggccgucgaccuccgccgccacaccgcccgcaaguccuccaucaaggccgccguccccggcaacaccuccacccccuccugccaguccaccaacggccagccccagcgcggcgccugcggccgcuggcgcggccgcucccgcucccgccgcgccgccaccucccgccccgagcgcgucuggcccgacggcgucauccccuucgucaucggcggcaacuucaccggcucccagcgcgccgucuuccgccaggccaugcgccacugggagaagcacaccugcgucaccuuccucgagcgcaccgacgaggacuccuacaucgucuucaccuaccgccccugcggcugcugcuccuacgucggccgccgcggcggcggcccccaggccaucuccaucggcaagaacugcgacaaguucggcaucgucguccacgagcucggccacgucgucggcuucuggcacgagcacacccgccccgaccgcgaccgccacgucuccaucguccgcgagaacauccagcccggccaggaguacaacuuccucaagauggagccccaggaggucgagucccucggcgagaccuacgacuucgacuccaucaugcacuacgcccgcaacaccuucucccgcggcaucuuccucgacaccaucguccccaaguacgaggucaacggcgucaagccccccaucggccagcgcacccgccucuccaagggcgacaucgcccaggcccgcaagcucuacaagugccccgccugcggcgagacccuccaggacuccaccggcaacuucuccucccccgaguaccccaacggcuacuccgcccacaugcacugcgucuggcgcaucuccgucacccccggcgagaagaucauccucaacuucaccucccucgaccucuaccgcucccgccucugcugguacgacuacgucgagguccgcgacggcuucuggcgcaaggccccccuccgcggccgcuucugcggcuccaagcuccccgagcccaucgucuccaccgacucccgccucugggucgaguuccgcuccuccuccaacugggucggcaagggcuucuucgccgucuacgaggccaucugcggcggcgacgucaagaaggacuacggccacauccagucccccaacuaccccgacgacuaccgccccuccaaggucugcaucuggcgcauccaggucuccgagggcuuccacgucggccucaccuuccaguccuucgagaucgagcgccacgacuccugcgccuacgacuaccucgagguccgcgacggccacuccgaguccuccacccucaucggccgcuacugcggcuacgagaagcccgacgacaucaaguccaccuccucccgccucuggcucaaguucgucuccgacggcuccaucaacaaggccggcuucgccgucaacuucuucaaggaggucgacgagugcucccgccccaaccgcggcggcugcgagcagcgcugccucaacacccucggcuccuacaagugcuccugcgaccccggcuacgagcucgcccccgacaagcgccgcugcgaggccgccugcggcggcuuccucaccaagcucaacggcuccaucaccucccccggcuggcccaaggaguacccccccaacaagaacugcaucuggcagcucgucgcccccacccaguaccgcaucucccuccaguucgacuucuucgagaccgagggcaacgacgucugcaaguacgacuucgucgagguccgcuccggccucaccgccgacuccaagcuccacggcaaguucugcggcuccgagaagcccgaggucaucaccucccaguacaacaacaugcgcgucgaguucaaguccgacaacaccgucuccaagaagggcuucaaggcccacuucuucuccgacaaggacgagugcuccaaggacaacggcggcugccagcaggacugcgucaacaccuucggcuccuacgagugccagugccgcuccggcuucguccuccacgacaacaagcacgacugcaaggaggccggcugcgaccacaaggucaccuccaccuccggcaccaucaccucccccaacuggcccgacaaguaccccuccaagaaggagugcaccugggccaucuccuccacccccggccaccgcgucaagcucaccuucauggagauggacaucgagucccagcccgagugcgccuacgaccaccucgaggucuucgacggccgcgacgccaaggcccccguccucggccgcuucugcggcuccaagaagcccgagcccguccucgccaccggcucccgcauguuccuccgcuucuacuccgacaacuccguccagcgcaagggcuuccaggccucccacgccaccgagugcggcggccagguccgcgccgacgucaagaccaaggaccucuacucccacgcccaguucggcgacaacaacuaccccggcggcgucgacugcgagugggucaucgucgccgaggagggcuacggcgucgagcucgucuuccagaccuucgaggucgaggaggagaccgacugcggcuacgacuacauggagcucuucgacggcuacgacuccaccgccccccgccucggccgcuacugcggcuccggcccccccgaggaggucuacuccgccggcgacuccguccucgucaaguuccacuccgacgacaccaucaccaagaagggcuuccaccuccgcuacaccuccaccaaguuccaggacacccuccacucccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4028 - RNA, 1538 nt, Artificial Sequence
  mRNA product Design3 comprising derived and/or modified sequence from Homo sapiens__NP_001191.1__HsBMP2 (opt2)
gggagagucccgcagucggcguccagcggcucugcuuguucgugugugugucguugcaggccuuauucaagcuuaccauggucgccggcacccgcugccuccucgcccuccuccucccccagguccuccucggcggcgccgccggccucguccccgagcucggccgccgcaaguucgccgccgccuccuccggccgccccuccucccagcccuccgacgagguccucuccgaguucgagcuccgccuccucuccauguucggccucaagcagcgccccacccccucccgcgacgccgucgucccccccuacaugcucgaccucuaccgccgccacuccggccagcccggcucccccgcccccgaccaccgccucgagcgcgccgccucccgcgccaacaccguccgcuccuuccaccacgaggagucccucgaggagcuccccgagaccuccggcaagaccacccgccgcuucuucuucaaccucuccuccauccccaccgaggaguucaucaccuccgccgagcuccaggucuuccgcgagcagaugcaggacgcccucggcaacaacuccuccuuccaccaccgcaucaacaucuacgagaucaucaagcccgccaccgccaacuccaaguuccccgucacccgccuccucgacacccgccucgucaaccagaacgccucccgcugggaguccuucgacgucacccccgccgucaugcgcuggaccgcccagggccacgccaaccacggcuucgucgucgaggucgcccaccucgaggagaagcagggcgucuccaagcgccacguccgcaucucccgcucccuccaccaggacgagcacuccuggucccagauccgcccccuccucgucaccuucggccacgacggcaagggccacccccuccacaagcgcgagaagcgccaggccaagcacaagcagcgcaagcgccucaaguccuccugcaagcgccacccccucuacgucgacuucuccgacgucggcuggaacgacuggaucgucgccccccccggcuaccacgccuucuacugccacggcgagugccccuucccccucgccgaccaccucaacuccaccaaccacgccaucguccagacccucgucaacuccgucaacuccaagauccccaaggccugcugcguccccaccgagcucuccgccaucuccaugcucuaccucgacgagaacgagaaggucguccucaagaacuaccaggacauggucgucgagggcugcggcugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4029 - RNA, 1574 nt, Artificial Sequence
  mRNA product Design3 comprising derived and/or modified sequence from Homo sapiens__NP_001193.2__HsBMP4 (opt2)
gggagagucccgcagucggcguccagcggcucugcuuguucgugugugugucguugcaggccuuauucaagcuuaccaugauccccggcaaccgcaugcucauggucguccuccucugccagguccuccucggcggcgccucccacgccucccucauccccgagaccggcaagaagaaggucgccgagauccagggccacgccggcggccgccgcuccggccagucccacgagcuccuccgcgacuucgaggccacccuccuccagauguucggccuccgccgccgcccccagcccuccaaguccgccgucauccccgacuacaugcgcgaccucuaccgccuccaguccggcgaggaggaggaggagcagauccacuccaccggccucgaguaccccgagcgccccgccucccgcgccaacaccguccgcuccuuccaccacgaggagcaccucgagaacauccccggcaccuccgagaacuccgccuuccgcuuccucuucaaccucuccuccauccccgagaacgaggucaucuccuccgccgagcuccgccucuuccgcgagcaggucgaccagggccccgacugggagcgcggcuuccaccgcaucaacaucuacgaggucaugaagccccccgccgaggucguccccggccaccucaucacccgccuccucgacacccgccucguccaccacaacgucacccgcugggagaccuucgacgucucccccgccguccuccgcuggacccgcgagaagcagcccaacuacggccucgccaucgaggucacccaccuccaccagacccgcacccaccagggccagcacguccgcaucucccgcucccucccccagggcuccggcaacugggcccagcuccgcccccuccucgucaccuucggccacgacggccgcggccacgcccucacccgccgccgccgcgccaagcgcucccccaagcaccacucccagcgcgcccgcaagaagaacaagaacugccgccgccacucccucuacgucgacuucuccgacgucggcuggaacgacuggaucgucgccccccccggcuaccaggccuucuacugccacggcgacugccccuucccccucgccgaccaccucaacuccaccaaccacgccaucguccagacccucgucaacuccgucaacuccuccauccccaaggccugcugcguccccaccgagcucuccgccaucuccaugcucuaccucgacgaguacgacaaggucguccucaagaacuaccaggagauggucgucgagggcugcggcugccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4030 - RNA, 1889 nt, Artificial Sequence
  mRNA product Design3 comprising derived and/or modified sequence from Homo sapiens__NP_001709.1__HsBMP6 (opt2)
gggagagucccgcagucggcguccagcggcucugcuuguucgugugugugucguugcaggccuuauucaagcuuaccaugcccggccucggccgccgcgcccaguggcucugcuggugguggggccuccucugcuccugcugcggcccccccccccuccgccccccccuccccgccgccgccgccgccgccgccggcggccagcuccucggcgacggcggcucccccggccgcaccgagcagcccccccccuccccccaguccuccuccggcuuccucuaccgccgccucaagacccaggagaagcgcgagaugcagaaggagauccucuccguccucggccucccccaccgcccccgcccccuccacggccuccagcagccccagccccccgcccuccgccagcaggaggagcagcagcagcagcagcagcucccccgcggcgagcccccccccggccgccucaaguccgccccccucuucaugcucgaccucuacaacgcccucuccgccgacaacgacgaggacggcgccuccgagggcgagcgccagcaguccuggccccacgaggccgccuccuccucccagcgccgccagcccccccccggcgccgcccacccccucaaccgcaagucccuccucgcccccggcuccggcuccggcggcgccuccccccucaccuccgcccaggacuccgccuuccucaacgacgccgacauggucauguccuucgucaaccucgucgaguacgacaaggaguucuccccccgccagcgccaccacaaggaguucaaguucaaccucucccagauccccgagggcgaggucgucaccgccgccgaguuccgcaucuacaaggacugcgucaugggcuccuucaagaaccagaccuuccucaucuccaucuaccagguccuccaggagcaccagcaccgcgacuccgaccucuuccuccucgacacccgcgucgucugggccuccgaggagggcuggcucgaguucgacaucaccgccaccuccaaccucugggucgucaccccccagcacaacaugggccuccagcucuccgucgucacccgcgacggcguccacguccacccccgcgccgccggccucgucggccgcgacggccccuacgacaagcagcccuucauggucgccuucuucaaggucuccgagguccacguccgcaccacccgcuccgccuccucccgccgccgccagcagucccgcaaccgcuccacccagucccaggacgucgcccgcgucuccuccgccuccgacuacaacuccuccgagcucaagaccgccugccgcaagcacgagcucuacgucuccuuccaggaccucggcuggcaggacuggaucaucgcccccaagggcuacgccgccaacuacugcgacggcgagugcuccuucccccucaacgcccacaugaacgccaccaaccacgccaucguccagacccucguccaccucaugaaccccgaguacguccccaagcccugcugcgcccccaccaagcucaacgccaucuccguccucuacuucgacgacaacuccaacgucauccucaagaaguaccgcaacauggucguccgcgccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4031 - RNA, 1643 nt, Artificial Sequence
  mRNA product Design3 comprising derived and/or modified sequence from Homo sapiens__NP_001710.1__HsBMP7 (opt2)
gggagagucccgcagucggcguccagcggcucugcuuguucgugugugugucguugcaggccuuauucaagcuuaccaugcacguccgcucccuccgcgccgccgccccccacuccuucgucgcccucugggccccccucuuccuccuccgcuccgcccucgccgacuucucccucgacaacgagguccacuccuccuucauccaccgccgccuccgcucccaggagcgccgcgagaugcagcgcgagauccucuccauccucggccucccccaccgcccccgcccccaccuccagggcaagcacaacuccgcccccauguucaugcucgaccucuacaacgccauggccgucgaggagggcggcggccccggcggccagggcuucuccuaccccuacaaggccgucuucuccacccagggccccccccucgccucccuccaggacucccacuuccucaccgacgccgacauggucauguccuucgucaaccucgucgagcacgacaaggaguucuuccacccccgcuaccaccaccgcgaguuccgcuucgaccucuccaagauccccgagggcgaggccgucaccgccgccgaguuccgcaucuacaaggacuacauccgcgagcgcuucgacaacgagaccuuccgcaucuccgucuaccagguccuccaggagcaccucggccgcgaguccgaccucuuccuccucgacucccgcacccucugggccuccgaggagggcuggcucgucuucgacaucaccgccaccuccaaccacugggucgucaacccccgccacaaccucggccuccagcucuccgucgagacccucgacggccaguccaucaaccccaagcucgccggccucaucggccgccacggcccccagaacaagcagcccuucauggucgccuucuucaaggccaccgagguccacuuccgcuccauccgcuccaccggcuccaagcagcgcucccagaaccgcuccaagacccccaagaaccaggaggcccuccgcauggccaacgucgccgagaacuccuccuccgaccagcgccaggccugcaagaagcacgagcucuacgucuccuuccgcgaccucggcuggcaggacuggaucaucgcccccgagggcuacgccgccuacuacugcgagggcgagugcgccuucccccucaacuccuacaugaacgccaccaaccacgccaucguccagacccucguccacuucaucaaccccgagaccguccccaagcccugcugcgcccccacccagcucaacgccaucuccguccucuacuucgacgacuccuccaacgucauccucaagaaguaccgcaacauggucguccgcgccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4032 - RNA, 647 nt, Artificial Sequence
  mRNA product Design3 comprising derived and/or modified sequence from Homo sapiens__NP_006264.2__HsCCL7 (opt2)
gggagagucccgcagucggcguccagcggcucugcuuguucgugugugugucguugcaggccuuauucaagcuuaccaugaaggccuccgccgcccuccucugccuccuccucaccgccgccgccuucuccccccagggccucgcccagcccgucggcaucaacaccuccaccaccugcugcuaccgcuucaucaacaagaagauccccaagcagcgccucgaguccuaccgccgcaccaccuccucccacugcccccgcgaggccgucaucuucaagaccaagcucgacaaggagaucugcgccgaccccacccagaaguggguccaggacuucaugaagcaccucgacaagaagacccagacccccaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4033 - RNA, 3971 nt, Artificial Sequence
  mRNA product Design3 comprising derived and/or modified sequence from Homo sapiens__NP_001954.2__HsEGF (opt2)
gggagagucccgcagucggcguccagcggcucugcuuguucgugugugugucguugcaggccuuauucaagcuuaccaugcuccucacccucaucauccuccuccccgucgucuccaaguucuccuucgucucccucuccgccccccagcacugguccugccccgagggcacccucgccggcaacggcaacuccaccugcgucggccccgcccccuuccucaucuucucccacggcaacuccaucuuccgcaucgacaccgagggcaccaacuacgagcagcucgucgucgacgccggcgucuccgucaucauggacuuccacuacaacgagaagcgcaucuacugggucgaccucgagcgccagcuccuccagcgcgucuuccucaacggcucccgccaggagcgcgucugcaacaucgagaagaacgucuccggcauggccaucaacuggaucaacgaggaggucaucugguccaaccagcaggagggcaucaucaccgucaccgacaugaagggcaacaacucccacauccuccucuccgcccucaaguaccccgccaacgucgccgucgaccccgucgagcgcuucaucuucugguccuccgaggucgccggcucccucuaccgcgccgaccucgacggcgucggcgucaaggcccuccucgagaccuccgagaagaucaccgccgucucccucgacguccucgacaagcgccucuucuggauccaguacaaccgcgagggcuccaacucccucaucugcuccugcgacuacgacggcggcuccguccacaucuccaagcaccccacccagcacaaccucuucgccaugucccucuucggcgaccgcaucuucuacuccaccuggaagaugaagaccaucuggaucgccaacaagcacaccggcaaggacaugguccgcaucaaccuccacuccuccuucgucccccucggcgagcucaaggucguccacccccucgcccagcccaaggccgaggacgacaccugggagcccgagcagaagcucugcaagcuccgcaagggcaacugcuccuccaccgucugcggccaggaccuccagucccaccucugcaugugcgccgagggcuacgcccucucccgcgaccgcaaguacugcgaggacgucaacgagugcgccuucuggaaccacggcugcacccucggcugcaagaacacccccggcuccuacuacugcaccugccccgucggcuucguccuccuccccgacggcaagcgcugccaccagcucgucuccugcccccgcaacgucuccgagugcucccacgacugcguccucaccuccgagggcccccucugcuucugccccgagggcuccguccucgagcgcgacggcaagaccugcuccggcugcuccucccccgacaacggcggcugcucccagcucugcgucccccucucccccgucuccugggagugcgacugcuuccccggcuacgaccuccagcucgacgagaaguccugcgccgccuccggcccccagcccuuccuccucuucgccaacucccaggacauccgccacaugcacuucgacggcaccgacuacggcacccuccucucccagcagaugggcauggucuacgcccucgaccacgaccccgucgagaacaagaucuacuucgcccacaccgcccucaaguggaucgagcgcgccaacauggacggcucccagcgcgagcgccucaucgaggagggcgucgacguccccgagggccucgccgucgacuggaucggccgccgcuucuacuggaccgaccgcggcaagucccucaucggccgcuccgaccucaacggcaagcgcuccaagaucaucaccaaggagaacaucucccagccccgcggcaucgccguccaccccauggccaagcgccucuucuggaccgacaccggcaucaacccccgcaucgaguccuccucccuccagggccucggccgccucgucaucgccuccuccgaccucaucuggcccuccggcaucaccaucgacuuccucaccgacaagcucuacuggugcgacgccaagcaguccgucaucgagauggccaaccucgacggcuccaagcgccgccgccucacccagaacgacgucggccaccccuucgccgucgccgucuucgaggacuacgucugguucuccgacugggccaugcccuccgucaugcgcgucaacaagcgcaccggcaaggaccgcguccgccuccagggcuccaugcucaagcccuccucccucgucgucguccacccccucgccaagcccggcgccgaccccugccucuaccagaacggcggcugcgagcacaucugcaagaagcgccucggcaccgccuggugcuccugccgcgagggcuucaugaaggccuccgacggcaagaccugccucgcccucgacggccaccagcuccucgccggcggcgaggucgaccucaagaaccaggucaccccccucgacauccucuccaagacccgcgucuccgaggacaacaucaccgagucccagcacaugcucgucgccgagaucauggucuccgaccaggacgacugcgcccccgucggcugcuccauguacgcccgcugcaucuccgagggcgaggacgccaccugccagugccucaagggcuucgccggcgacggcaagcucugcuccgacaucgacgagugcgagaugggcguccccgucugcccccccgccuccuccaagugcaucaacaccgagggcggcuacgucugccgcugcuccgagggcuaccagggcgacggcauccacugccucgacaucgacgagugccagcucggcgagcacuccugcggcgagaacgccuccugcaccaacaccgagggcggcuacaccugcaugugcgccggccgccucuccgagcccggccucaucugccccgacuccaccccccccccccaccuccgcgaggacgaccaccacuacuccguccgcaacuccgacuccgagugcccccucucccacgacggcuacugccuccacgacggcgucugcauguacaucgaggcccucgacaaguacgccugcaacugcgucgucggcuacaucggcgagcgcugccaguaccgcgaccucaaguggugggagcuccgccacgccggccacggccagcagcagaaggucaucgucgucgccgucugcgucgucguccucgucaugcuccuccuccucucccucuggggcgcccacuacuaccgcacccagaagcuccucuccaagaaccccaagaaccccuacgaggaguccucccgcgacguccgcucccgccgccccgccgacaccgaggacggcauguccuccugcccccagcccugguucgucgucaucaaggagcaccaggaccucaagaacggcggccagcccgucgccggcgaggacggccaggccgccgacggcuccaugcagcccaccuccuggcgccaggagccccagcucugcggcaugggcaccgagcagggcugcuggauccccgucuccuccgacaagggcuccugcccccaggucauggagcgcuccuuccacaugcccuccuacggcacccagacccucgagggcggcgucgagaagccccacucccuccucuccgccaacccccucuggcagcagcgcgcccucgaccccccccaccagauggagcucacccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4034 - RNA, 857 nt, Artificial Sequence
  mRNA product Design3 comprising derived and/or modified sequence from Homo sapiens__NP_001423.1__HsEREG (opt2)
gggagagucccgcagucggcguccagcggcucugcuuguucgugugugugucguugcaggccuuauucaagcuuaccaugaccgccggccgccgcauggagaugcucugcgccggccgcguccccgcccuccuccucugccucggcuuccaccuccuccaggccguccucuccaccaccgucauccccuccugcauccccggcgaguccuccgacaacugcaccgcccucguccagaccgaggacaacccccgcgucgcccaggucuccaucaccaagugcuccuccgacaugaacggcuacugccuccacggccagugcaucuaccucgucgacaugucccagaacuacugccgcugcgaggucggcuacaccggcguccgcugcgagcacuucuuccucaccguccaccagccccucuccaaggaguacgucgcccucaccgucauccucaucauccucuuccucaucaccgucgucggcuccaccuacuacuucugccgcugguaccgcaaccgcaaguccaaggagcccaagaaggaguacgagcgcgucaccuccggcgaccccgagcucccccaggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4035 - RNA, 815 nt, Artificial Sequence
  mRNA product Design3 comprising derived and/or modified sequence from Homo sapiens__NP_000791.1__HsFGF1 (opt2)
gggagagucccgcagucggcguccagcggcucugcuuguucgugugugugucguugcaggccuuauucaagcuuaccauggccgagggcgagaucaccaccuucaccgcccucaccgagaaguucaaccucccccccggcaacuacaagaagcccaagcuccucuacugcuccaacggcggccacuuccuccgcauccuccccgacggcaccgucgacggcacccgcgaccgcuccgaccagcacauccagcuccagcucuccgccgaguccgucggcgaggucuacaucaaguccaccgagaccggccaguaccucgccauggacaccgacggccuccucuacggcucccagacccccaacgaggagugccucuuccucgagcgccucgaggagaaccacuacaacaccuacaucuccaagaagcacgccgagaagaacugguucgucggccucaagaagaacggcuccugcaagcgcggcccccgcacccacuacggccagaaggccauccucuuccucccccuccccgucuccuccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4036 - RNA, 1214 nt, Artificial Sequence
  mRNA product Design3 comprising derived and/or modified sequence from Homo sapiens__NP_001997.5__HsFGF2 (opt2)
gggagagucccgcagucggcguccagcggcucugcuuguucgugugugugucguugcaggccuuauucaagcuuaccauggucggcgucggcggcggcgacgucgaggacgucaccccccgccccggcggcugccagaucuccggccgcggcgcccgcggcugcaacggcauccccggcgccgccgccugggaggccgcccucccccgccgccgcccccgccgccaccccuccgucaacccccgcucccgcgccgccggcuccccccgcacccgcggccgccgcaccgaggagcgccccuccggcucccgccucggcgaccgcggccgcggccgcgcccuccccggcggccgccucggcggccgcggccgcggccgcgcccccgagcgcgucggcggccgcggccgcggccgcggcaccgccgccccccgcgccgcccccgccgcccgcggcucccgccccggccccgccggcaccauggccgccggcuccaucaccacccuccccgcccuccccgaggacggcggcuccggcgccuucccccccggccacuucaaggaccccaagcgccucuacugcaagaacggcggcuucuuccuccgcauccaccccgacggccgcgucgacggcguccgcgagaaguccgacccccacaucaagcuccagcuccaggccgaggagcgcggcgucgucuccaucaagggcgucugcgccaaccgcuaccucgccaugaaggaggacggccgccuccucgccuccaagugcgucaccgacgagugcuucuucuucgagcgccucgaguccaacaacuacaacaccuaccgcucccgcaaguacaccuccugguacgucgcccucaagcgcaccggccaguacaagcucggcuccaagaccggccccggccagaaggccauccucuuccuccccauguccgccaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4037 - RNA, 932 nt, Artificial Sequence
  mRNA product Design3 comprising derived and/or modified sequence from Homo sapiens__NP_002000.1__HsFGF7 (opt2)
gggagagucccgcagucggcguccagcggcucugcuuguucgugugugugucguugcaggccuuauucaagcuuaccaugcacaaguggauccucaccuggauccuccccacccuccucuaccgcuccugcuuccacaucaucugccucgucggcaccaucucccucgccugcaacgacaugacccccgagcagauggccaccaacgucaacugcuccucccccgagcgccacacccgcuccuacgacuacauggagggcggcgacauccgcguccgccgccucuucugccgcacccagugguaccuccgcaucgacaagcgcggcaaggucaagggcacccaggagaugaagaacaacuacaacaucauggagauccgcaccgucgccgucggcaucgucgccaucaagggcgucgaguccgaguucuaccucgccaugaacaaggagggcaagcucuacgccaagaaggagugcaacgaggacugcaacuucaaggagcucauccucgagaaccacuacaacaccuacgccuccgccaaguggacccacaacggcggcgagauguucgucgcccucaaccagaagggcauccccguccgcggcaagaagaccaagaaggagcagaagaccgcccacuuccuccccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4038 - RNA, 974 nt, Artificial Sequence
  mRNA product Design3 comprising derived and/or modified sequence from Homo sapiens__NP_001936.1__HsHBEGF (opt2)
gggagagucccgcagucggcguccagcggcucugcuuguucgugugugugucguugcaggccuuauucaagcuuaccaugaagcuccuccccuccgucguccucaagcucuuccucgccgccguccucuccgcccucgucaccggcgagucccucgagcgccuccgccgcggccucgccgccggcaccuccaaccccgacccccccaccgucuccaccgaccagcuccucccccucggcggcggccgcgaccgcaagguccgcgaccuccaggaggccgaccucgaccuccuccgcgucacccucuccuccaagccccaggcccucgccacccccaacaaggaggagcacggcaagcgcaagaagaagggcaagggccucggcaagaagcgcgaccccugccuccgcaaguacaaggacuucugcauccacggcgagugcaaguacgucaaggagcuccgcgcccccuccugcaucugccaccccggcuaccacggcgagcgcugccacggccucucccuccccgucgagaaccgccucuacaccuacgaccacaccaccauccucgccgucgucgccgucguccucuccuccgucugccuccucgucaucgucggccuccucauguuccgcuaccaccgccgcggcggcuacgacgucgagaacgaggagaaggucaagcucggcaugaccaacucccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4039 - RNA, 2534 nt, Artificial Sequence
  mRNA product Design3 comprising derived and/or modified sequence from Homo sapiens__NP_000592.3__HsHGF (opt2)
gggagagucccgcagucggcguccagcggcucugcuuguucgugugugugucguugcaggccuuauucaagcuuaccaugugggucaccaagcuccuccccgcccuccuccuccagcacguccuccuccaccuccuccuccuccccaucgccauccccuacgccgagggccagcgcaagcgccgcaacaccauccacgaguucaagaaguccgccaagaccacccucaucaagaucgaccccgcccucaagaucaagaccaagaaggucaacaccgccgaccagugcgccaaccgcugcacccgcaacaagggccuccccuucaccugcaaggccuucgucuucgacaaggcccgcaagcagugccucugguuccccuucaacuccauguccuccggcgucaagaaggaguucggccacgaguucgaccucuacgagaacaaggacuacauccgcaacugcaucaucggcaagggccgcuccuacaagggcaccgucuccaucaccaaguccggcaucaagugccagcccugguccuccaugaucccccacgagcacuccuuccuccccuccuccuaccgcggcaaggaccuccaggagaacuacugccgcaacccccgcggcgaggagggcggccccuggugcuucaccuccaaccccgagguccgcuacgaggucugcgacaucccccagugcuccgaggucgagugcaugaccugcaacggcgaguccuaccgcggccucauggaccacaccgaguccggcaagaucugccagcgcugggaccaccagaccccccaccgccacaaguuccuccccgagcgcuaccccgacaagggcuucgacgacaacuacugccgcaaccccgacggccagccccgccccuggugcuacacccucgacccccacacccgcugggaguacugcgccaucaagaccugcgccgacaacaccaugaacgacaccgacgucccccucgagaccaccgagugcauccagggccagggcgagggcuaccgcggcaccgucaacaccaucuggaacggcauccccugccagcgcugggacucccaguacccccacgagcacgacaugacccccgagaacuucaagugcaaggaccuccgcgagaacuacugccgcaaccccgacggcuccgagucccccuggugcuucaccaccgaccccaacauccgcgucggcuacugcucccagauccccaacugcgacaugucccacggccaggacugcuaccgcggcaacggcaagaacuacaugggcaaccucucccagacccgcuccggccucaccugcuccaugugggacaagaacauggaggaccuccaccgccacaucuucugggagcccgacgccuccaagcucaacgagaacuacugccgcaaccccgacgacgacgcccacggccccuggugcuacaccggcaacccccucauccccugggacuacugccccaucucccgcugcgagggcgacaccacccccaccaucgucaaccucgaccaccccgucaucuccugcgccaagaccaagcagcuccgcgucgucaacggcauccccacccgcaccaacaucggcuggauggucucccuccgcuaccgcaacaagcacaucugcggcggcucccucaucaaggaguccuggguccucaccgcccgccagugcuuccccucccgcgaccucaaggacuacgaggccuggcucggcauccacgacguccacggccgcggcgacgagaagugcaagcagguccucaacgucucccagcucgucuacggccccgagggcuccgaccucguccucaugaagcucgcccgccccgccguccucgacgacuucgucuccaccaucgaccuccccaacuacggcugcaccauccccgagaagaccuccugcuccgucuacggcuggggcuacaccggccucaucaacuacgacggccuccuccgcgucgcccaccucuacaucaugggcaacgagaagugcucccagcaccaccgcggcaaggucacccucaacgaguccgagaucugcgccggcgccgagaagaucggcuccggccccugcgagggcgacuacggcggcccccucgucugcgagcagcacaagaugcgcaugguccucggcgucaucguccccggccgcggcugcgccauccccaaccgccccggcaucuucguccgcgucgccuacuacgccaaguggauccacaagaucauccucaccuacaaggucccccaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4040 - RNA, 2273 nt, Artificial Sequence
  mRNA product Design3 comprising derived and/or modified sequence from Homo sapiens__NP_005336.3 __HsHSPA1A (opt2)
gggagagucccgcagucggcguccagcggcucugcuuguucgugugugugucguugcaggccuuauucaagcuuaccauggccaaggccgccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgcccucaacccccagaacaccgucuucgacgccaagcgccucaucggccgcaaguucggcgaccccgucguccaguccgacaugaagcacuggcccuuccaggucaucaacgacggcgacaagcccaagguccaggucuccuacaagggcgagaccaaggccuucuaccccgaggagaucuccuccaugguccucaccaagaugaaggagaucgccgaggccuaccucggcuaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgaccgcaccggcaagggcgagcgcaacguccucaucuucgaccucggcggcggcaccuucgacgucuccauccucaccaucgacgacggcaucuucgaggucaaggccaccgccggcgacacccaccucggcggcgaggacuucgacaaccgccucgucaaccacuucgucgaggaguucaagcgcaagcacaagaaggacaucucccagaacaagcgcgccguccgccgccuccgcaccgccugcgagcgcgccaagcgcacccucuccuccuccacccaggccucccucgagaucgacucccucuucgagggcaucgacuucuacaccuccaucacccgcgcccgcuucgaggagcucugcuccgaccucuuccgcuccacccucgagcccgucgagaaggcccuccgcgacgccaagcucgacaaggcccagauccacgaccucguccucgucggcggcuccacccgcauccccaagguccagaagcuccuccaggacuucuucaacggccgcgaccucaacaaguccaucaaccccgacgaggccgucgccuacggcgccgccguccaggccgccauccucaugggcgacaaguccgagaacguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucaacgucaccgccaccgacaaguccaccggcaaggccaacaagaucaccaucaccaacgacaagggccgccucuccaaggaggagaucgagcgcaugguccaggaggccgagaaguacaaggccgaggacgagguccagcgcgagcgcgucuccgccaagaacgcccucgaguccuacgccuucaacaugaaguccgccgucgaggacgagggccucaagggcaagaucuccgaggccgacaagaagaagguccucgacaagugccaggaggucaucuccuggcucgacgccaacacccucgccgagaaggacgaguucgagcacaagcgcaaggagcucgagcaggucugcaaccccaucaucuccggccucuaccagggcgccggcggccccggccccggcggcuucggcgcccagggccccaagggcggcuccggcuccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4041 - RNA, 2273 nt, Artificial Sequence; identical to SEQ ID NO: 4040
  mRNA product Design3 comprising derived and/or modified sequence from Homo sapiens__NP_005337.2 __HsHSPA1B (opt2)

SEQ ID NO: 4042 - RNA, 2273 nt, Artificial Sequence
  mRNA product Design3 comprising derived and/or modified sequence from Homo sapiens__NP_005518.3 __HsHSPA1L (opt2)
gggagagucccgcagucggcguccagcggcucugcuuguucgugugugugucguugcaggccuuauucaagcuuaccauggccaccgccaagggcaucgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaacccccagaacaccgucuucgacgccaagcgccucaucggccgcaaguucaacgaccccgucguccaggccgacaugaagcucuggcccuuccaggucaucaacgagggcggcaagcccaagguccucgucuccuacaagggcgagaacaaggccuucuaccccgaggagaucuccuccaugguccucaccaagcucaaggagaccgccgaggccuuccucggccaccccgucaccaacgccgucaucaccguccccgccuacuucaacgacucccagcgccaggccaccaaggacgccggcgucaucgccggccucaacguccuccgcaucaucaacgagcccaccgccgccgccaucgccuacggccucgacaagggcggccagggcgagcgccacguccucaucuucgaccucggcggcggcaccuucgacgucuccauccucaccaucgacgacggcaucuucgaggucaaggccaccgccggcgacacccaccucggcggcgaggacuucgacaaccgccucgucucccacuucgucgaggaguucaagcgcaagcacaagaaggacaucucccagaacaagcgcgccguccgccgccuccgcaccgccugcgagcgcgccaagcgcacccucuccuccuccacccaggccaaccucgagaucgacucccucuacgagggcaucgacuucuacaccuccaucacccgcgcccgcuucgaggagcucugcgccgaccucuuccgcggcacccucgagcccgucgagaaggcccuccgcgacgccaagauggacaaggccaagauccacgacaucguccucgucggcggcuccacccgcauccccaagguccagcgccuccuccaggacuacuucaacggccgcgaccucaacaaguccaucaaccccgacgaggccgucgccuacggcgccgccguccaggccgccauccucaugggcgacaaguccgagaagguccaggaccuccuccuccucgacgucgccccccucucccucggccucgagaccgccggcggcgucaugaccgcccucaucaagcgcaacuccaccauccccaccaagcagacccagaucuucaccaccuacuccgacaaccagcccggcguccucauccaggucuacgagggcgagcgcgccaugaccaaggacaacaaccuccucggccgcuucgaccucaccggcaucccccccgccccccgcggcgucccccagaucgaggucaccuucgacaucgacgccaacggcauccucaacgucaccgccaccgacaaguccaccggcaaggucaacaagaucaccaucaccaacgacaagggccgccucuccaaggaggagaucgagcgcaugguccucgacgccgagaaguacaaggccgaggacgagguccagcgcgagaagaucgccgccaagaacgcccucgaguccuacgccuucaacaugaaguccgucgucuccgacgagggccucaagggcaagaucuccgaguccgacaagaacaagauccucgacaagugcaacgagcuccucuccuggcucgaggucaaccagcucgccgagaaggacgaguucgaccacaagcgcaaggagcucgagcagaugugcaaccccaucaucaccaagcucuaccagggcggcugcaccggccccgccugcggcaccggcuacguccccggccgccccgccaccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4043 - RNA, 2267 nt, Artificial Sequence
  mRNA product Design3 comprising derived and/or modified sequence from Homo sapiens__NP_068814.2 __HsHSPA2 (opt2)
gggagagucccgcagucggcguccagcggcucugcuuguucgugugugugucguugcaggccuuauucaagcuuaccauguccgcccgcggccccgccaucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccaucuucgacgccaagcgccucaucggccgcaaguucgaggacgccaccguccaguccgacaugaagcacuggcccuuccgcgucgucuccgagggcggcaagcccaagguccaggucgaguacaagggcgagaccaagaccuucuuccccgaggagaucuccuccaugguccucaccaagaugaaggagaucgccgaggccuaccucggcggcaagguccacuccgccgucaucaccguccccgccuacuucaacgacucccagcgccaggccaccaaggacgccggcaccaucaccggccucaacguccuccgcaucaucaacgagcccaccgccgccgccaucgccuacggccucgacaagaagggcugcgccggcggcgagaagaacguccucaucuucgaccucggcggcggcaccuucgacgucuccauccucaccaucgaggacggcaucuucgaggucaaguccaccgccggcgacacccaccucggcggcgaggacuucgacaaccgcauggucucccaccucgccgaggaguucaagcgcaagcacaagaaggacaucggccccaacaagcgcgccguccgccgccuccgcaccgccugcgagcgcgccaagcgcacccucuccuccuccacccaggccuccaucgagaucgacucccucuacgagggcgucgacuucuacaccuccaucacccgcgcccgcuucgaggagcucaacgccgaccucuuccgcggcacccucgagcccgucgagaaggcccuccgcgacgccaagcucgacaagggccagauccaggagaucguccucgucggcggcuccacccgcauccccaagauccagaagcuccuccaggacuucuucaacggcaaggagcucaacaaguccaucaaccccgacgaggccgucgccuacggcgccgccguccaggccgccauccucaucggcgacaaguccgagaacguccaggaccuccuccuccucgacgucaccccccucucccucggcaucgagaccgccggcggcgucaugaccccccucaucaagcgcaacaccaccauccccaccaagcagacccagaccuucaccaccuacuccgacaaccaguccuccguccucguccaggucuacgagggcgagcgcgccaugaccaaggacaacaaccuccucggcaaguucgaccucaccggcaucccccccgccccccgcggcgucccccagaucgaggucaccuucgacaucgacgccaacggcauccucaacgucaccgccgccgacaaguccaccggcaaggagaacaagaucaccaucaccaacgacaagggccgccucuccaaggacgacaucgaccgcaugguccaggaggccgagcgcuacaaguccgaggacgaggccaaccgcgaccgcgucgccgccaagaacgcccucgaguccuacaccuacaacaucaagcagaccgucgaggacgagaagcuccgcggcaagaucuccgagcaggacaagaacaagauccucgacaagugccaggaggucaucaacuggcucgaccgcaaccagauggccgagaaggacgaguacgagcacaagcagaaggagcucgagcgcgucugcaaccccaucaucuccaagcucuaccagggcggccccggcggcggcuccggcggcggcggcuccggcgccuccggcggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4044 - RNA, 2870 nt, Artificial Sequence
  mRNA product Design3 comprising derived and/or modified sequence from Homo sapiens__NP_002145.3 __HsHSPA4 (opt2)
gggagagucccgcagucggcguccagcggcucugcuuguucgugugugugucguugcaggccuuauucaagcuuaccauguccgucgucggcaucgaccucggcuuccaguccugcuacgucgccgucgcccgcgccggcggcaucgagaccaucgccaacgaguacuccgaccgcugcacccccgccugcaucuccuucggccccaagaaccgcuccaucggcgccgccgccaagucccaggucaucuccaacgccaagaacaccguccagggcuucaagcgcuuccacggccgcgccuucuccgaccccuucgucgaggccgagaaguccaaccucgccuacgacaucguccagcuccccaccggccucaccggcaucaaggucaccuacauggaggaggagcgcaacuucaccaccgagcaggucaccgccaugcuccucuccaagcucaaggagaccgccgaguccguccucaagaagcccgucgucgacugcgucgucuccguccccugcuucuacaccgacgccgagcgccgcuccgucauggacgccacccagaucgccggccucaacugccuccgccucaugaacgagaccaccgccgucgcccucgccuacggcaucuacaagcaggaccuccccgcccucgaggagaagccccgcaacgucgucuucgucgacaugggccacuccgccuaccaggucuccgucugcgccuucaaccgcggcaagcucaagguccucgccaccgccuucgacaccacccucggcggccgcaaguucgacgagguccucgucaaccacuucugcgaggaguucggcaagaaguacaagcucgacaucaaguccaagauccgcgcccuccuccgccucucccaggagugcgagaagcucaagaagcucauguccgccaacgccuccgaccucccccucuccaucgagugcuucaugaacgacgucgacgucuccggcaccaugaaccgcggcaaguuccucgagaugugcaacgaccuccucgcccgcgucgagcccccccuccgcuccguccucgagcagaccaagcucaagaaggaggacaucuacgccgucgagaucgucggcggcgccacccgcauccccgccgucaaggagaagaucuccaaguucuucggcaaggagcucuccaccacccucaacgccgacgaggccgucacccgcggcugcgcccuccagugcgccauccucucccccgccuucaagguccgcgaguucuccaucaccgacgucguccccuaccccaucucccuccgcuggaacucccccgccgaggagggcuccuccgacugcgaggucuucuccaagaaccacgccgcccccuucuccaagguccucaccuucuaccgcaaggagcccuucacccucgaggccuacuacuccuccccccaggaccuccccuaccccgaccccgccaucgcccaguucuccguccagaaggucaccccccaguccgacggcuccuccuccaaggucaaggucaagguccgcgucaacguccacggcaucuucuccgucuccuccgccucccucgucgagguccacaaguccgaggagaacgaggagcccauggagaccgaccagaacgccaaggaggaggagaagaugcaggucgaccaggaggagccccacgucgaggagcagcagcagcagacccccgccgagaacaaggccgaguccgaggagauggagaccucccaggccggcuccaaggacaagaagauggaccagcccccccaggccaagaaggccaaggucaagaccuccaccgucgaccuccccaucgagaaccagcuccucuggcagaucgaccgcgagaugcucaaccucuacaucgagaacgagggcaagaugaucaugcaggacaagcucgagaaggagcgcaacgacgccaagaacgccgucgaggaguacgucuacgagaugcgcgacaagcucuccggcgaguacgagaaguucgucuccgaggacgaccgcaacuccuucacccucaagcucgaggacaccgagaacuggcucuacgaggacggcgaggaccagcccaagcaggucuacgucgacaagcucgccgagcucaagaaccucggccagcccaucaagauccgcuuccaggaguccgaggagcgccccaagcucuucgaggagcucggcaagcagauccagcaguacaugaagaucaucuccuccuucaagaacaaggaggaccaguacgaccaccucgacgccgccgacaugaccaaggucgagaaguccaccaacgaggccauggaguggaugaacaacaagcucaaccuccagaacaagcagucccucaccauggaccccgucgucaaguccaaggagaucgaggccaagaucaaggagcucaccuccaccugcucccccaucaucuccaagcccaagcccaaggucgagccccccaaggaggagcagaagaacgccgagcagaacggccccgucgacggccagggcgacaaccccggcccccaggccgccgagcagggcaccgacaccgccguccccuccgacuccgacaagaagcuccccgagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4045 - RNA, 2867 nt, Artificial Sequence
  mRNA product Design3 comprising derived and/or modified sequence from Homo sapiens__NP_055093.2 __HsHSPA4L (opt2)
gggagagucccgcagucggcguccagcggcucugcuuguucgugugugugucguugcaggccuuauucaagcuuaccauguccgucgucggcaucgaccucggcuuccucaacugcuacaucgccgucgcccgcuccggcggcaucgagaccaucgccaacgaguacuccgaccgcugcacccccgccugcaucucccucggcucccgcacccgcgccaucggcaacgccgccaagucccagaucgucaccaacguccgcaacaccauccacggcuucaagaagcuccacggccgcuccuucgacgaccccaucguccagaccgagcgcauccgccuccccuacgagcuccagaagaugcccaacggcuccgccggcgucaagguccgcuaccucgaggaggagcgccccuucgccaucgagcaggucaccggcaugcuccucgccaagcucaaggagaccuccgagaacgcccucaagaagcccgucgccgacugcgucaucuccauccccuccuucuucaccgacgccgagcgccgcuccgucauggccgccgcccaggucgccggccucaacugccuccgccucaugaacgagaccaccgccgucgcccucgccuacggcaucuacaagcaggaccuccccccccucgacgagaagccccgcaacgucgucuucaucgacaugggccacuccgccuaccagguccucgucugcgccuucaacaagggcaagcucaagguccucgccaccaccuucgaccccuaccucggcggccgcaacuucgacgaggcccucgucgacuacuucugcgacgaguucaagaccaaguacaagaucaacgucaaggagaacucccgcgcccuccuccgccucuaccaggagugcgagaagcucaagaagcucauguccgccaacgccuccgaccucccccucaacaucgagugcuucaugaacgaccucgacgucuccuccaagaugaaccgcgcccaguucgagcagcucugcgccucccuccucgcccgcgucgagcccccccucaaggccgucauggagcaggccaaccuccagcgcgaggacaucuccuccaucgagaucgucggcggcgccacccgcauccccgccgucaaggagcagaucaccaaguucuuccucaaggacaucuccaccacccucaacgccgacgaggccgucgcccgcggcugcgcccuccagugcgccauccucucccccgccuucaagguccgcgaguucuccaucaccgaccucguccccuacuccaucacccuccgcuggaagaccuccuucgaggacggcuccggcgagugcgaggucuucugcaagaaccaccccgcccccuucuccaaggucaucaccuuccacaagaaggagcccuucgagcucgaggccuucuacaccaaccuccacgagguccccuaccccgacgcccgcaucggcuccuucaccauccagaacgucuucccccaguccgacggcgacuccuccaaggucaaggucaagguccgcgucaacauccacggcaucuucuccgucgccuccgccuccgucaucgagaagcagaaccucgagggcgaccacuccgacgcccccauggagaccgagaccuccuucaagaacgagaacaaggacaacauggacaagaugcaggucgaccaggaggagggccaccagaagugccacgccgagcacacccccgaggaggagaucgaccacaccggcgccaagaccaaguccgccgucuccgacaagcaggaccgccucaaccagacccucaagaagggcaaggucaaguccaucgaccuccccauccaguccucccucugccgccagcucggccaggaccuccucaacuccuacaucgagaacgagggcaagaugaucaugcaggacaagcucgagaaggagcgcaacgacgccaagaacgccgucgaggaguacgucuacgacuuccgcgaccgccucggcaccgucuacgagaaguucaucacccccgaggaccucuccaagcucuccgccguccucgaggacaccgagaacuggcucuacgaggacggcgaggaccagcccaagcaggucuacgucgacaagcuccaggagcucaagaaguacggccagcccauccagaugaaguacauggagcacgaggagcgccccaaggcccucaacgaccucggcaagaagauccagcucgucaugaaggucaucgaggccuaccgcaacaaggacgagcgcuacgaccaccucgaccccaccgagauggagaaggucgagaagugcaucuccgacgccauguccuggcucaacuccaagaugaacgcccagaacaagcucucccucacccaggaccccgucgucaaggucuccgagaucgucgccaaguccaaggagcucgacaacuucugcaaccccaucaucuacaagcccaagcccaaggccgagguccccgaggacaagcccaaggccaacuccgagcacaacggccccauggacggccaguccggcaccgagaccaaguccgacuccaccaaggacuccucccagcacaccaaguccuccggcgagauggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4046 - RNA, 2312 nt, Artificial Sequence
  mRNA product Design3 comprising derived and/or modified sequence from Homo sapiens__NP_005338.1__HsHSPA5 (opt2)
gggagagucccgcagucggcguccagcggcucugcuuguucgugugugugucguugcaggccuuauucaagcuuaccaugaagcucucccucgucgccgccaugcuccuccuccucuccgccgcccgcgccgaggaggaggacaagaaggaggacgucggcaccgucgucggcaucgaccucggcaccaccuacuccugcgucggcgucuucaagaacggccgcgucgagaucaucgccaacgaccagggcaaccgcaucacccccuccuacgucgccuucacccccgagggcgagcgccucaucggcgacgccgccaagaaccagcucaccuccaaccccgagaacaccgucuucgacgccaagcgccucaucggccgcaccuggaacgaccccuccguccagcaggacaucaaguuccuccccuucaaggucgucgagaagaagaccaagcccuacauccaggucgacaucggcggcggccagaccaagaccuucgcccccgaggagaucuccgccaugguccucaccaagaugaaggagaccgccgaggccuaccucggcaagaaggucacccacgccgucgucaccguccccgccuacuucaacgacgcccagcgccaggccaccaaggacgccggcaccaucgccggccucaacgucaugcgcaucaucaacgagcccaccgccgccgccaucgccuacggccucgacaagcgcgagggcgagaagaacauccucgucuucgaccucggcggcggcaccuucgacgucucccuccucaccaucgacaacggcgucuucgaggucgucgccaccaacggcgacacccaccucggcggcgaggacuucgaccagcgcgucauggagcacuucaucaagcucuacaagaagaagaccggcaaggacguccgcaaggacaaccgcgccguccagaagcuccgccgcgaggucgagaaggccaagcgcgcccucuccucccagcaccaggcccgcaucgagaucgaguccuucuacgagggcgaggacuucuccgagacccucacccgcgccaaguucgaggagcucaacauggaccucuuccgcuccaccaugaagcccguccagaagguccucgaggacuccgaccucaagaaguccgacaucgacgagaucguccucgucggcggcuccacccgcauccccaagauccagcagcucgucaaggaguucuucaacggcaaggagcccucccgcggcaucaaccccgacgaggccgucgccuacggcgccgccguccaggccggcguccucuccggcgaccaggacaccggcgaccucguccuccucgacgucugcccccucacccucggcaucgagaccgucggcggcgucaugaccaagcucaucccccgcaacaccgucguccccaccaagaagucccagaucuucuccaccgccuccgacaaccagcccaccgucaccaucaaggucuacgagggcgagcgcccccucaccaaggacaaccaccuccucggcaccuucgaccucaccggcaucccccccgccccccgcggcgucccccagaucgaggucaccuucgagaucgacgucaacggcauccuccgcgucaccgccgaggacaagggcaccggcaacaagaacaagaucaccaucaccaacgaccagaaccgccucacccccgaggagaucgagcgcauggucaacgacgccgagaaguucgccgaggaggacaagaagcucaaggagcgcaucgacacccgcaacgagcucgaguccuacgccuacucccucaagaaccagaucggcgacaaggagaagcucggcggcaagcucuccuccgaggacaaggagaccauggagaaggccgucgaggagaagaucgaguggcucgagucccaccaggacgccgacaucgaggacuucaaggccaagaagaaggagcucgaggagaucguccagcccaucaucuccaagcucuacggcuccgccggccccccccccaccggcgaggaggacaccgccgagaaggacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4047 - RNA, 2279 nt, Artificial Sequence
  mRNA product Design3 comprising derived and/or modified sequence from Homo sapiens__NP_002146.2__HsHSPA6 (opt2)
gggagagucccgcagucggcguccagcggcucugcuuguucgugugugugucguugcaggccuuauucaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccgcgucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccgccuacuucaacgacucccagcgccaggccaccaaggacgccggcgccaucgccggccucaacguccuccgcaucaucaacgagcccaccgccgccgccaucgccuacggccucgaccgccgcggcgccggcgagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccucuccuccuccacccaggccacccucgagaucgacucccucuucgagggcgucgacuucuacaccuccaucacccgcgcccgcuucgaggagcucugcuccgaccucuuccgcuccacccucgagcccgucgagaaggcccuccgcgacgccaagcucgacaaggcccagauccacgacgucguccucgucggcggcuccacccgcauccccaagguccagaagcuccuccaggacuucuucaacggcaaggagcucaacaaguccaucaaccccgacgaggccgucgccuacggcgccgccguccaggccgccguccucaugggcgacaagugcgagaagguccaggaccuccuccuccucgacgucgccccccucucccucggccucgagaccgccggcggcgucaugaccacccucauccagcgcaacgccaccauccccaccaagcagacccagaccuucaccaccuacuccgacaaccagcccggcgucuucauccaggucuacgagggcgagcgcgccaugaccaaggacaacaaccuccucggccgcuucgagcucuccggcaucccccccgccccccgcggcgucccccagaucgaggucaccuucgacaucgacgccaacggcauccucuccgucaccgccaccgaccgcuccaccggcaaggccaacaagaucaccaucaccaacgacaagggccgccucuccaaggaggaggucgagcgcaugguccacgaggccgagcaguacaaggccgaggacgaggcccagcgcgaccgcgucgccgccaagaacucccucgaggcccacgucuuccacgucaagggcucccuccaggaggagucccuccgcgacaagauccccgaggaggaccgccgcaagaugcaggacaagugccgcgagguccucgccuggcucgagcacaaccagcucgccgagaaggaggaguacgagcaccagaagcgcgagcucgagcagaucugccgccccaucuucucccgccucuacggcggccccggcguccccggcggcuccuccugcggcacccaggcccgccagggcgaccccuccaccggccccaucaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4048 - RNA, 1451 nt, Artificial Sequence
  mRNA product Design3 comprising derived and/or modified sequence from Homo sapiens__P48741__HsHSPA7 (opt2)
gggagagucccgcagucggcguccagcggcucugcuuguucgugugugugucguugcaggccuuauucaagcuuaccaugcaggccccccgcgagcucgccgucggcaucgaccucggcaccaccuacuccugcgucggcgucuuccagcagggccgcgucgagauccucgccaacgaccagggcaaccgcaccacccccuccuacgucgccuucaccgacaccgagcgccucgucggcgacgccgccaagucccaggccgcccucaacccccacaacaccgucuucgacgccaagcgccucaucggccgcaaguucgccgacaccaccguccaguccgacaugaagcacuggcccuuccaggucgucuccgagggcggcaagcccaagguccgcgucugcuaccgcggcgaggacaagaccuucuaccccgaggagaucuccuccaugguccucuccaagaugaaggagaccgccgaggccuaccucggccagcccgucaagcacgccgucaucaccguccccaccuacuucuccaacucccagcgccaggccaccaaggacgccggcgccaucgccggccucaagguccuccccaucaucaacgaggccaccgccgccgccaucgccuacggccucgaccgccgcggcgccggcaagcgcaacguccucaucuucgaccucggcggcggcaccuucgacgucuccguccucuccaucgacgccggcgucuucgaggucaaggccaccgccggcgacacccaccucggcggcgaggacuucgacaaccgccucgucaaccacuucauggaggaguuccgccgcaagcacggcaaggaccucuccggcaacaagcgcgcccuccgccgccuccgcaccgccugcgagcgcgccaagcgcacccccuccuccuccacccaggccacccucgagaucgacucccucuucgagggcgucgacuucuacaaguccaucacccgcgcccgcuucgaggagcucugcuccgaccucuuccgcuccacccucgagcccgucgagaaggcccuccgcgacgccaagcucgacaaggcccagauccacgacuucguccucggcggcggccuccacucccacccccagggcgccgaggucgccgccggccuccuccagcgccagggcgccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4049 - RNA, 2288 nt, Artificial Sequence
  mRNA product Design3 comprising derived and/or modified sequence from Homo sapiens__NP_006588.1 __HsHSPA8 (opt2)
gggagagucccgcagucggcguccagcggcucugcuuguucgugugugugucguugcaggccuuauucaagcuuaccauguccaagggccccgccgucggcaucgaccucggcaccaccuacuccugcgucggcgucuuccagcacggcaaggucgagaucaucgccaacgaccagggcaaccgcaccacccccuccuacgucgccuucaccgacaccgagcgccucaucggcgacgccgccaagaaccaggucgccaugaaccccaccaacaccgucuucgacgccaagcgccucaucggccgccgcuucgacgacgccgucguccaguccgacaugaagcacuggcccuucauggucgucaacgacgccggccgccccaagguccaggucgaguacaagggcgagaccaaguccuucuaccccgaggaggucuccuccaugguccucaccaagaugaaggagaucgccgaggccuaccucggcaagaccgucaccaacgccgucgucaccguccccgccuacuucaacgacucccagcgccaggccaccaaggacgccggcaccaucgccggccucaacguccuccgcaucaucaacgagcccaccgccgccgccaucgccuacggccucgacaagaaggucggcgccgagcgcaacguccucaucuucgaccucggcggcggcaccuucgacgucuccauccucaccaucgaggacggcaucuucgaggucaaguccaccgccggcgacacccaccucggcggcgaggacuucgacaaccgcauggucaaccacuucaucgccgaguucaagcgcaagcacaagaaggacaucuccgagaacaagcgcgccguccgccgccuccgcaccgccugcgagcgcgccaagcgcacccucuccuccuccacccaggccuccaucgagaucgacucccucuacgagggcaucgacuucuacaccuccaucacccgcgcccgcuucgaggagcucaacgccgaccucuuccgcggcacccucgaccccgucgagaaggcccuccgcgacgccaagcucgacaagucccagauccacgacaucguccucgucggcggcuccacccgcauccccaagauccagaagcuccuccaggacuucuucaacggcaaggagcucaacaaguccaucaaccccgacgaggccgucgccuacggcgccgccguccaggccgccauccucuccggcgacaaguccgagaacguccaggaccuccuccuccucgacgucaccccccucucccucggcaucgagaccgccggcggcgucaugaccguccucaucaagcgcaacaccaccauccccaccaagcagacccagaccuucaccaccuacuccgacaaccagcccggcguccucauccaggucuacgagggcgagcgcgccaugaccaaggacaacaaccuccucggcaaguucgagcucaccggcaucccccccgccccccgcggcgucccccagaucgaggucaccuucgacaucgacgccaacggcauccucaacgucuccgccgucgacaaguccaccggcaaggagaacaagaucaccaucaccaacgacaagggccgccucuccaaggaggacaucgagcgcaugguccaggaggccgagaaguacaaggccgaggacgagaagcagcgcgacaaggucuccuccaagaacucccucgaguccuacgccuucaacaugaaggccaccgucgaggacgagaagcuccagggcaagaucaacgacgaggacaagcagaagauccucgacaagugcaacgagaucaucaacuggcucgacaagaaccagaccgccgagaaggaggaguucgagcaccagcagaaggagcucgagaaggucugcaaccccaucaucaccaagcucuaccaguccgccggcggcaugcccggcggcaugcccggcggcuuccccggcggcggcgccccccccuccggcggcgccuccuccggccccaccaucgaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4050 - RNA, 2387 nt, Artificial Sequence
  mRNA product Design3 comprising derived and/or modified sequence from Homo sapiens__NP_004125.3 __HsHSPA9 (opt2)
gggagagucccgcagucggcguccagcggcucugcuuguucgugugugugucguugcaggccuuauucaagcuuaccaugaucuccgccucccgcgccgccgccgcccgccucgucggcgccgccgccucccgcggccccaccgccgcccgccaccaggacuccuggaacggccucucccacgaggccuuccgccucgucucccgccgcgacuacgccuccgaggccaucaagggcgccgucgucggcaucgaccucggcaccaccaacuccugcgucgccgucauggagggcaagcaggccaagguccucgagaacgccgagggcgcccgcaccacccccuccgucgucgccuucaccgccgacggcgagcgccucgucggcaugcccgccaagcgccaggccgucaccaaccccaacaacaccuucuacgccaccaagcgccucaucggccgccgcuacgacgaccccgagguccagaaggacaucaagaacguccccuucaagaucguccgcgccuccaacggcgacgccugggucgaggcccacggcaagcucuacucccccucccagaucggcgccuucguccucaugaagaugaaggagaccgccgagaacuaccucggccacaccgccaagaacgccgucaucaccguccccgccuacuucaacgacucccagcgccaggccaccaaggacgccggccagaucuccggccucaacguccuccgcgucaucaacgagcccaccgccgccgcccucgccuacggccucgacaaguccgaggacaaggucaucgccgucuacgaccucggcggcggcaccuucgacaucuccauccucgagauccagaagggcgucuucgaggucaaguccaccaacggcgacaccuuccucggcggcgaggacuucgaccaggcccuccuccgccacaucgucaaggaguucaagcgcgagaccggcgucgaccucaccaaggacaacauggcccuccagcgcguccgcgaggccgccgagaaggccaagugcgagcucuccuccuccguccagaccgacaucaaccuccccuaccucaccauggacuccuccggccccaagcaccucaacaugaagcucacccgcgcccaguucgagggcaucgucaccgaccucauccgccgcaccaucgcccccugccagaaggccaugcaggacgccgaggucuccaaguccgacaucggcgaggucauccucgucggcggcaugacccgcaugcccaagguccagcagaccguccaggaccucuucggccgcgcccccuccaaggccgucaaccccgacgaggccgucgccaucggcgccgccauccagggcggcguccucgccggcgacgucaccgacguccuccuccucgacgucaccccccucucccucggcaucgagacccucggcggcgucuucaccaagcucaucaaccgcaacaccaccauccccaccaagaagucccaggucuucuccaccgccgccgacggccagacccaggucgagaucaaggucugccagggcgagcgcgagauggccggcgacaacaagcuccucggccaguucacccucaucggcaucccccccgccccccgcggcgucccccagaucgaggucaccuucgacaucgacgccaacggcaucguccacgucuccgccaaggacaagggcaccggccgcgagcagcagaucgucauccaguccuccggcggccucuccaaggacgacaucgagaacauggucaagaacgccgagaaguacgccgaggaggaccgccgcaagaaggagcgcgucgaggccgucaacauggccgagggcaucauccacgacaccgagaccaagauggaggaguucaaggaccagcuccccgccgacgagugcaacaagcucaaggaggagaucuccaagaugcgcgagcuccucgcccgcaaggacuccgagaccggcgagaacauccgccaggccgccuccucccuccagcaggccucccucaagcucuucgagauggccuacaagaagauggccuccgagcgcgagggcuccggcuccuccggcaccggcgagcagaaggaggaccagaaggaggagaagcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4051 - RNA, 2375 nt, Artificial Sequence
  mRNA product Design3 comprising derived and/or modified sequence from Homo sapiens__NP_079291.2__HsHSPA12A (opt2)
gggagagucccgcagucggcguccagcggcucugcuuguucgugugugugucguugcaggccuuauucaagcuuaccauggccgacaaggaggccggcggcuccgacggcccccgcgagaccgcccccaccuccgccuacuccucccccgcccgcucccucggcgacaccggcaucaccccccucucccccucccacaucgucaacgacaccgacuccaacgucuccgagcagcaguccuuccucgucgucgucgccgucgacuucggcaccaccuccuccggcuacgccuacuccuucaccaaggagcccgagugcauccacgucaugcgccgcugggagggcggcgaccccggcgucuccaaccagaagacccccaccaccauccuccucacccccgagcgcaaguuccacuccuucggcuacgccgcccgcgacuucuaccacgaccucgaccccaacgaggccaagcaguggcucuaccucgagaaguucaagaugaagcuccacaccaccggcgaccucaccauggacaccgaccucaccgccgccaacggcaagaaggucaaggcccucgagaucuucgccuacgcccuccaguacuucaaggagcaggcccucaaggagcucuccgaccaggccggcuccgaguucgagaacuccgacguccgcugggucaucaccguccccgccaucuggaagcagcccgccaagcaguucaugcgccaggccgccuaccaggccggccucgccucccccgagaacuccgagcagcucaucaucgcccucgagcccgaggccgccuccaucuacugccgcaagcuccgccuccaccagaugaucgagcucuccuccaaggccgccgucaacggcuacuccggcuccgacaccgucggcgccggcuucacccaggccaaggagcacauccgccgcaaccgccagucccgcaccuuccucgucgagaacgucaucggcgagaucugguccgagcucgaggagggcgacaaguacgucgucgucgacuccggcggcggcaccgucgaccucaccguccaccagauccgccuccccgagggccaccucaaggagcucuacaaggccaccggcggccccuacggcucccucggcgucgacuacgaguucgagaagcuccucuacaagaucuucggcgaggacuucaucgagcaguucaagaucaagcgccccgccgccugggucgaccucaugaucgccuucgagucccgcaagcgcgccgccgcccccgaccgcaccaacccccucaacaucacccuccccuucuccuucaucgacuacuacaagaaguuccgcggccacuccgucgagcacgcccuccgcaaguccaacgucgacuucgucaagugguccucccagggcaugcuccgcaugucccccgacgccaugaacgcccucuucaagcccaccaucgacuccaucaucgagcaccuccgcgaccucuuccagaagcccgaggucuccaccgucaaguuccucuuccucgucggcggcuucgccgaggccccccuccuccagcaggccguccaggccgccuucggcgaccagugccgcaucaucaucccccaggacgucggccucaccauccucaagggcgccguccucuucggccucgaccccgccgucaucaagguccgccgcuccccccucaccuacggcgucggcguccucaaccgcuacgucgagggcaagcacccccccgagaagcuccucgucaaggacggcacccgcuggugcaccgacgucuucgacaaguucaucuccgccgaccaguccgucgcccucggcgagcucgucaagcgcuccuacacccccgccaagcccucccagcucgucaucgucaucaacaucuacuccuccgagcacgacaacgucuccuucaucaccgaccccggcgucaagaagugcggcacccuccgccucgaccucaccggcaccuccggcaccgccguccccgcccgccgcgagauccagacccucaugcaguucggcgacaccgagaucaaggccaccgccaucgacaucgccaccuccaaguccgucaaggucggcaucgacuuccucaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4052 - RNA, 2408 nt, Artificial Sequence
  mRNA product Design3 comprising derived and/or modified sequence from Homo sapiens__NP_443202.3 __HsHSPA12B (opt2)
gggagagucccgcagucggcguccagcggcucugcuuguucgugugugugucguugcaggccuuauucaagcuuaccaugcucgccguccccgagaugggccuccagggccucuacaucggcuccucccccgagcgcucccccguccccuccccccccggcuccccccgcacccaggaguccugcggcaucgccccccucacccccucccagucccccaagcccgagguccgcgccccccagcaggccuccuucuccgucgucgucgccaucgacuucggcaccaccuccuccggcuacgccuucuccuucgccuccgaccccgaggccauccacaugaugcgcaagugggagggcggcgaccccggcgucgcccaccagaagacccccaccugccuccuccucacccccgagggcgccuuccacuccuucggcuacaccgcccgcgacuacuaccacgaccucgaccccgaggaggcccgcgacuggcucuacuucgagaaguucaagaugaagauccacuccgccaccgaccucacccucaagacccagcucgaggccgucaacggcaagaccaugcccgcccucgaggucuucgcccacgcccuccgcuucuuccgcgagcacgcccuccaggagcuccgcgagcagucccccucccuccccgagaaggacaccguccgcuggguccucaccguccccgccaucuggaagcagcccgccaagcaguucaugcgcgaggccgccuaccucgccggccucgucucccgcgagaacgccgagcagcuccucaucgcccucgagcccgaggccgccuccgucuacugccgcaagcuccgccuccaccagcuccucgaccucuccggccgcgcccccggcggcggccgccucggcgagcgccgcuccaucgacuccuccuuccgccaggcccgcgagcagcuccgccgcucccgccacucccgcaccuuccucgucgaguccggcgucggcgagcucugggccgagaugcaggccggcgaccgcuacgucgucgccgacugcggcggcggcaccgucgaccucaccguccaccagcucgagcagccccacggcacccucaaggagcucuacaaggccuccggcggccccuacggcgccgucggcgucgaccucgccuucgagcagcuccucugccgcaucuucggcgaggacuucaucgccaccuucaagcgccagcgccccgccgccugggucgaccucaccaucgccuucgaggcccgcaagcgcaccgccggcccccaccgcgccggcgcccucaacaucucccuccccuucuccuucaucgacuucuaccgcaagcagcgcggccacaacgucgagaccgcccuccgccgcuccuccgucaacuucgucaagugguccucccagggcaugcuccgcauguccugcgaggccaugaacgagcucuuccagcccaccgucuccggcaucauccagcacaucgaggcccuccucgcccgccccgagguccagggcgucaagcuccucuuccucgucggcggcuucgccgaguccgccguccuccagcacgccguccaggccgcccucggcgcccgcggccuccgcgucgucgucccccacgacgucggccucaccauccucaagggcgccguccucuucggccaggcccccggcgucguccgcguccgccgcuccccccucaccuacggcgucggcguccucaaccgcuucguccccggccgccacccccccgagaagcuccucguccgcgacggccgccgcuggugcaccgacgucuucgagcgcuucgucgccgccgagcaguccgucgcccucggcgaggagguccgccgcuccuacugccccgcccgccccggccagcgccgcguccucaucaaccucuacugcugcgccgccgaggacgcccgcuucaucaccgaccccggcguccgcaagugcggcgcccucucccucgagcucgagcccgccgacugcggccaggacaccgccggcgccccccccggccgccgcgagauccgcgccgccaugcaguucggcgacaccgagaucaaggucaccgccgucgacgucuccaccaaccgcuccguccgcgccuccaucgacuuccucuccaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4053 - RNA, 1763 nt, Artificial Sequence
  mRNA product Design3 comprising derived and/or modified sequence from Homo sapiens__NP_008879.3__HsHSPA13 (opt2)
gggagagucccgcagucggcguccagcggcucugcuuguucgugugugugucguugcaggccuuauucaagcuuaccauggcccgcgagaugaccauccucggcuccgccguccucacccuccuccucgccggcuaccucgcccagcaguaccucccccuccccacccccaaggucaucggcaucgaccucggcaccaccuacugcuccgucggcgucuucuuccccggcaccggcaaggucaaggucauccccgacgagaacggccacaucuccauccccuccauggucuccuucaccgacaacgacgucuacgucggcuacgaguccgucgagcucgccgacuccaacccccagaacaccaucuacgacgccaagcgcuucaucggcaagaucuucaccgccgaggagcucgaggccgagaucggccgcuaccccuucaagguccucaacaagaacggcauggucgaguucuccgucaccuccaacgagaccaucaccgucucccccgaguacgucggcucccgccuccuccucaagcucaaggagauggccgaggccuaccucggcaugcccgucgccaacgccgucaucuccguccccgccgaguucgaccucaagcagcgcaacuccaccaucgaggccgccaaccucgccggccucaagauccuccgcgucaucaacgagcccaccgccgccgccauggccuacggccuccacaaggccgacgucuuccacguccucgucaucgaccucggcggcggcacccucgacgucucccuccucaacaagcagggcggcauguuccucacccgcgccauguccggcaacaacaagcucggcggccaggacuucaaccagcgccuccuccaguaccucuacaagcagaucuaccagaccuacggcuucguccccucccgcaaggaggagauccaccgccuccgccaggccgucgagauggucaagcucaaccucacccuccaccaguccgcccagcucuccguccuccucaccgucgaggagcaggaccgcaaggagccccacuccuccgacaccgagcuccccaaggacaagcucuccuccgccgacgaccaccgcgucaacuccggcuucggccgcggccucuccgacaagaaguccggcgagucccagguccucuucgagaccgagaucucccgcaagcucuucgacacccucaacgaggaccucuuccagaagauccucguccccauccagcagguccucaaggagggccaccucgagaagaccgagaucgacgaggucguccucgucggcggcuccacccgcaucccccgcauccgccaggucauccaggaguucuucggcaaggaccccaacaccuccgucgaccccgaccucgccgucgucaccggcgucgccauccaggccggcaucgacggcggcuccuggccccuccaggucuccgcccucgagauccccaacaagcaccuccagaagaccaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4054 - RNA, 1877 nt, Artificial Sequence
  mRNA product Design3 comprising derived and/or modified sequence from Homo sapiens__NP_057383.2__HsHSPA14 (opt2)
gggagagucccgcagucggcguccagcggcucugcuuguucgugugugugucguugcaggccuuauucaagcuuaccauggccgccaucggcguccaccucggcugcaccuccgccugcgucgccgucuacaaggacggccgcgccggcgucgucgccaacgacgccggcgaccgcgucacccccgccgucgucgccuacuccgagaacgaggagaucgucggccucgccgccaagcagucccgcauccgcaacaucuccaacaccgucaugaaggucaagcagauccucggccgcuccuccuccgacccccaggcccagaaguacaucgccgaguccaagugccucgucaucgagaagaacggcaagcuccgcuacgagaucgacaccggcgaggagaccaaguucgucaaccccgaggacgucgcccgccucaucuucuccaagaugaaggagaccgcccacuccguccucggcuccgacgccaacgacgucgucaucaccguccccuucgacuucggcgagaagcagaagaacgcccucggcgaggccgcccgcgccgccggcuucaacguccuccgccucauccacgagcccuccgccgcccuccucgccuacggcaucggccaggacucccccaccggcaaguccaacauccucgucuucaagcucggcggcaccucccucucccucuccgucauggaggucaacuccggcaucuaccgcguccucuccaccaacaccgacgacaacaucggcggcgcccacuucaccgagacccucgcccaguaccucgccuccgaguuccagcgcuccuucaagcacgacguccgcggcaacgcccgcgccaugaugaagcucaccaacuccgccgaggucgccaagcacucccucuccacccucggcuccgccaacugcuuccucgacucccucuacgagggccaggacuucgacugcaacgucucccgcgcccgcuucgagcuccucugcuccccccucuucaacaagugcaucgaggccauccgcggccuccucgaccagaacggcuucaccgccgacgacaucaacaaggucguccucugcggcggcuccucccgcauccccaagcuccagcagcucaucaaggaccucuuccccgccgucgagcuccucaacuccaucccccccgacgaggucauccccaucggcgccgccaucgaggccggcauccucaucggcaaggagaaccuccucgucgaggacucccucaugaucgagugcuccgcccgcgacauccucgucaagggcgucgacgaguccggcgccucccgcuucaccguccucuuccccuccggcaccccccuccccgcccgccgccagcacacccuccaggcccccggcuccaucuccuccgucugccucgagcucuacgaguccgacggcaagaacuccgccaaggaggagaccaaguucgcccaggucguccuccaggaccucgacaagaaggagaacggccuccgcgacauccucgccguccucaccaugaagcgcgacggcucccuccacgucaccugcaccgaccaggagaccggcaagugcgaggccaucuccaucgagaucgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4055 - RNA, 2924 nt, Artificial Sequence
  mRNA product Design3 comprising derived and/or modified sequence from Homo sapiens__NP_006635.2 __HsHSPH1 (opt2)
gggagagucccgcagucggcguccagcggcucugcuuguucgugugugugucguugcaggccuuauucaagcuuaccauguccgucgucggccucgacgucggcucccaguccugcuacaucgccgucgcccgcgccggcggcaucgagaccaucgccaacgaguucuccgaccgcugcacccccuccgucaucuccuucggcuccaagaaccgcaccaucggcgucgccgccaagaaccagcagaucacccacgccaacaacaccgucuccaacuucaagcgcuuccacggccgcgccuucaacgaccccuucauccagaaggagaaggagaaccucuccuacgaccucgucccccucaagaacggcggcgucggcaucaaggucauguacaugggcgaggagcaccucuucuccgucgagcagaucaccgccaugcuccucaccaagcucaaggagaccgccgagaacucccucaagaagcccgucaccgacugcgucaucuccguccccuccuucuucaccgacgccgagcgccgcuccguccucgacgccgcccagaucgucggccucaacugccuccgccucaugaacgacaugaccgccgucgcccucaacuacggcaucuacaagcaggaccuccccucccucgacgagaagccccgcaucgucgucuucgucgacaugggccacuccgccuuccaggucuccgccugcgccuucaacaagggcaagcucaagguccucggcaccgccuucgaccccuuccucggcggcaagaacuucgacgagaagcucgucgagcacuucugcgccgaguucaagaccaaguacaagcucgacgccaaguccaagauccgcgcccuccuccgccucuaccaggagugcgagaagcucaagaagcucauguccuccaacuccaccgaccucccccucaacaucgagugcuucaugaacgacaaggacgucuccggcaagaugaaccgcucccaguucgaggagcucugcgccgagcuccuccagaagaucgaggucccccucuacucccuccucgagcagacccaccucaaggucgaggacgucuccgccgucgagaucgucggcggcgccacccgcauccccgccgucaaggagcgcaucgccaaguucuucggcaaggacaucuccaccacccucaacgccgacgaggccgucgcccgcggcugcgcccuccagugcgccauccucucccccgccuucaagguccgcgaguucuccgucaccgacgccguccccuuccccaucucccucaucuggaaccacgacuccgaggacaccgagggcguccacgaggucuucucccgcaaccacgccgcccccuucuccaagguccucaccuuccuccgccgcggccccuucgagcucgaggccuucuacuccgacccccagggcguccccuaccccgaggccaagaucggccgcuucgucguccagaacgucuccgcccagaaggacggcgagaagucccgcgucaaggucaagguccgcgucaacacccacggcaucuucaccaucuccaccgccuccauggucgagaagguccccaccgaggagaacgagauguccuccgaggccgacauggagugccucaaccagcgcccccccgagaaccccgacaccgacaagaacguccagcaggacaacuccgaggccggcacccagccccagguccagaccgacgcccagcagaccucccaguccccccccucccccgagcucaccuccgaggagaacaagauccccgacgccgacaaggccaacgagaagaaggucgaccagccccccgaggccaagaagcccaagaucaaggucgucaacgucgagcuccccaucgaggccaaccucgucuggcagcucggcaaggaccuccucaacauguacaucgagaccgagggcaagaugaucaugcaggacaagcucgagaaggagcgcaacgacgccaagaacgccgucgaggaguacgucuacgaguuccgcgacaagcucugcggccccuacgagaaguucaucugcgagcaggaccaccagaacuuccuccgccuccucaccgagaccgaggacuggcucuacgaggagggcgaggaccaggccaagcaggccuacgucgacaagcucgaggagcucaugaagaucggcacccccgucaagguccgcuuccaggaggccgaggagcgccccaagauguucgaggagcucggccagcgccuccagcacuacgccaagaucgccgccgacuuccgcaacaaggacgagaaguacaaccacaucgacgaguccgagaugaagaaggucgagaaguccgucaacgaggucauggaguggaugaacaacgucaugaacgcccaggccaagaagucccucgaccaggaccccgucguccgcgcccaggagaucaagaccaagaucaaggagcucaacaacaccugcgagcccgucgucacccagcccaagcccaagaucgagucccccaagcucgagcgcacccccaacggccccaacaucgacaagaaggaggaggaccucgaggacaagaacaacuucggcgccgagcccccccaccagaacggcgagugcuaccccaacgagaagaacuccgucaacauggaccucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4056 - RNA, 3347 nt, Artificial Sequence
  mRNA product Design3 comprising derived and/or modified sequence from Homo sapiens__NP_006380.1 __HsHYOU1 (opt2)
gggagagucccgcagucggcguccagcggcucugcuuguucgugugugugucguugcaggccuuauucaagcuuaccauggccgacaagguccgccgccagcgcccccgccgccgcgucugcugggcccucgucgccguccuccucgccgaccuccucgcccucuccgacacccucgccgucauguccgucgaccucggcuccgaguccaugaaggucgccaucgucaagcccggcguccccauggagaucguccucaacaaggagucccgccgcaagacccccgucaucgucacccucaaggagaacgagcgcuucuucggcgacuccgccgccuccauggccaucaagaaccccaaggccacccuccgcuacuuccagcaccuccucggcaagcaggccgacaacccccacgucgcccucuaccaggcccgcuuccccgagcacgagcucaccuucgacccccagcgccagaccguccacuuccagaucuccucccagcuccaguucucccccgaggagguccucggcaugguccucaacuacucccgcucccucgccgaggacuucgccgagcagcccaucaaggacgccgucaucaccguccccgucuucuucaaccaggccgagcgccgcgccguccuccaggccgcccgcauggccggccucaagguccuccagcucaucaacgacaacaccgccaccgcccucuccuacggcgucuuccgccgcaaggacaucaacaccaccgcccagaacaucauguucuacgacaugggcuccggcuccaccgucugcaccaucgucaccuaccagauggucaagaccaaggaggccggcaugcagccccagcuccagauccgcggcgucggcuucgaccgcacccucggcggccucgagauggagcuccgccuccgcgagcgccucgccggccucuucaacgagcagcgcaagggccagcgcgccaaggacguccgcgagaacccccgcgccauggccaagcuccuccgcgaggccaaccgccucaagaccguccucuccgccaacgccgaccacauggcccagaucgagggccucauggacgacgucgacuucaaggccaaggucacccgcgucgaguucgaggagcucugcgccgaccucuucgagcgcguccccggccccguccagcaggcccuccaguccgccgagaugucccucgacgagaucgagcaggucauccucgucggcggcgccacccgcgucccccgcguccaggagguccuccucaaggccgucggcaaggaggagcucggcaagaacaucaacgccgacgaggccgccgccaugggcgccgucuaccaggccgccgcccucuccaaggccuucaaggucaagcccuucgucguccgcgacgccgucgucuaccccauccucgucgaguucacccgcgaggucgaggaggagcccggcauccacucccucaagcacaacaagcgcguccucuucucccgcaugggccccuacccccagcgcaaggucaucaccuucaaccgcuacucccacgacuucaacuuccacaucaacuacggcgaccucggcuuccucggccccgaggaccuccgcgucuucggcucccagaaccucaccaccgucaagcucaagggcgucggcgacuccuucaagaaguaccccgacuacgaguccaagggcaucaaggcccacuucaaccucgacgaguccggcguccucucccucgaccgcgucgaguccgucuucgagacccucgucgaggacuccgccgaggaggaguccacccucaccaagcucggcaacaccaucuccucccucuucggcggcggcaccacccccgacgccaaggagaacggcaccgacaccguccaggaggaggaggagucccccgccgagggcuccaaggacgagcccggcgagcaggucgagcucaaggaggaggccgaggcccccgucgaggacggcucccagccccccccccccgagcccaagggcgacgccacccccgagggcgagaaggccaccgagaaggagaacggcgacaaguccgaggcccagaagcccuccgagaaggccgaggccggccccgagggcgucgcccccgcccccgagggcgagaagaagcagaagcccgcccgcaagcgccgcauggucgaggagaucggcgucgagcucgucguccucgaccuccccgaccuccccgaggacaagcucgcccaguccguccagaagcuccaggaccucacccuccgcgaccucgagaagcaggagcgcgagaaggccgccaacucccucgaggccuucaucuucgagacccaggacaagcucuaccagcccgaguaccaggaggucuccaccgaggagcagcgcgaggagaucuccggcaagcucuccgccgccuccaccuggcucgaggacgagggcgucggcgccaccaccgucaugcucaaggagaagcucgccgagcuccgcaagcucugccagggccucuucuuccgcgucgaggagcgcaagaaguggcccgagcgccucuccgcccucgacaaccuccucaaccacuccuccauguuccucaagggcgcccgccucauccccgagauggaccagaucuucaccgaggucgagaugaccacccucgagaaggucaucaacgagaccugggccuggaagaacgccacccucgccgagcaggccaagcuccccgccaccgagaagcccguccuccucuccaaggacaucgaggccaagaugauggcccucgaccgcgagguccaguaccuccucaacaaggccaaguucaccaagccccgcccccgccccaaggacaagaacggcacccgcgccgagcccccccucaacgccuccgccuccgaccagggcgagaaggucaucccccccgccggccagaccgaggacgccgagcccaucuccgagcccgagaaggucgagaccggcuccgagcccggcgacaccgagccccucgagcucggcggccccggcgccgagcccgagcagaaggagcaguccaccggccagaagcgcccccucaagaacgacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4057 - RNA, 2546 nt, Artificial Sequence
  mRNA product Design3 comprising derived and/or modified sequence from Homo sapiens__NP_005339.3 __HsHSP90AA1 (opt2)
gggagagucccgcagucggcguccagcggcucugcuuguucgugugugugucguugcaggccuuauucaagcuuaccaugcccgaggagacccagacccaggaccagcccauggaggaggaggaggucgagaccuucgccuuccaggccgagaucgcccagcucaugucccucaucaucaacaccuucuacuccaacaaggagaucuuccuccgcgagcucaucuccaacuccuccgacgcccucgacaagauccgcuacgagucccucaccgaccccuccaagcucgacuccggcaaggagcuccacaucaaccucauccccaacaagcaggaccgcacccucaccaucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucaccgucaucaccaagcacaacgacgacgagcaguacgccugggaguccuccgccggcggcuccuucaccguccgcaccgacaccggcgagcccaugggccgcggcaccaaggucauccuccaccucaaggaggaccagaccgaguaccucgaggagcgccgcaucaaggagaucgucaagaagcacucccaguucaucggcuaccccaucacccucuucgucgagaaggagcgcgacaaggaggucuccgacgacgaggccgaggagaaggaggacaaggaggaggagaaggagaaggaggagaaggaguccgaggacaagcccgagaucgaggacgucggcuccgacgaggaggaggagaagaaggacggcgacaagaagaagaagaagaagaucaaggagaaguacaucgaccaggaggagcucaacaagaccaagcccaucuggacccgcaaccccgacgacaucaccaacgaggaguacggcgaguucuacaagucccucaccaacgacugggaggaccaccucgccgucaagcacuucuccgucgagggccagcucgaguuccgcgcccuccucuucgucccccgccgcgcccccuucgaccucuucgagaaccgcaagaagaagaacaacaucaagcucuacguccgccgcgucuucaucauggacaacugcgaggagcucauccccgaguaccucaacuucauccgcggcgucgucgacuccgaggaccucccccucaacaucucccgcgagaugcuccagcaguccaagauccucaaggucauccgcaagaaccucgucaagaagugccucgagcucuucaccgagcucgccgaggacaaggagaacuacaagaaguucuacgagcaguucuccaagaacaucaagcucggcauccacgaggacucccagaaccgcaagaagcucuccgagcuccuccgcuacuacaccuccgccuccggcgacgagauggucucccucaaggacuacugcacccgcaugaaggagaaccagaagcacaucuacuacaucaccggcgagaccaaggaccaggucgccaacuccgccuucgucgagcgccuccgcaagcacggccucgaggucaucuacaugaucgagcccaucgacgaguacugcguccagcagcucaaggaguucgagggcaagacccucgucuccgucaccaaggagggccucgagcuccccgaggacgaggaggagaagaagaagcaggaggagaagaagaccaaguucgagaaccucugcaagaucaugaaggacauccucgagaagaaggucgagaaggucgucgucuccaaccgccucgucaccucccccugcugcaucgucaccuccaccuacggcuggaccgccaacauggagcgcaucaugaaggcccaggcccuccgcgacaacuccaccaugggcuacauggccgccaagaagcaccucgagaucaaccccgaccacuccaucaucgagacccuccgccagaaggccgaggccgacaagaacgacaaguccgucaaggaccucgucauccuccucuacgagaccgcccuccucuccuccggcuucucccucgaggacccccagacccacgccaaccgcaucuaccgcaugaucaagcucggccucggcaucgacgaggacgaccccaccgccgacgacaccuccgccgccgucaccgaggagaugcccccccucgagggcgacgacgacaccucccgcauggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4058 - RNA, 686 nt, Artificial Sequence
  mRNA product Design3 comprising derived and/or modified sequence from Homo sapiens__NG_005218__HsHSP90AA3P (opt2)
gggagagucccgcagucggcguccagcggcucugcuuguucgugugugugucguugcaggccuuauucaagcuuaccauggacuccuccaagcucgacuccggcaagggccuccacaucaaccucguccccaacaagcagaaccagacccucaccaucgucgacacccgcaucggcaugaccaagaccgaccucaucaacaaccucggcaccgucaccaaguccggcaccaaggccuucauggaggcccuccaggccgacgccgacaucuccaugaucggccacuucggcgucggcuucuacuccgccuaccucgucgccaagaaggucaccgucaucuccaagcacaacaacgacgagcaguacaccugggaguccuccgccggcggcuccuucaccguccgcaccgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4059 - RNA, 2522 nt, Artificial Sequence
  mRNA product Design3 comprising derived and/or modified sequence from Homo sapiens__NP_031381.2__HsHSP90AB1 (opt2)
gggagagucccgcagucggcguccagcggcucugcuuguucgugugugugucguugcaggccuuauucaagcuuaccaugcccgaggagguccaccacggcgaggaggaggucgagaccuucgccuuccaggccgagaucgcccagcucaugucccucaucaucaacaccuucuacuccaacaaggagaucuuccuccgcgagcucaucuccaacgccuccgacgcccucgacaagauccgcuacgagucccucaccgaccccuccaagcucgacuccggcaaggagcucaagaucgacaucauccccaacccccaggagcgcacccucacccucgucgacaccggcaucggcaugaccaaggccgaccucaucaacaaccucggcaccaucgccaaguccggcaccaaggccuucauggaggcccuccaggccggcgccgacaucuccaugaucggccaguucggcgucggcuucuacuccgccuaccucgucgccgagaaggucgucgucaucaccaagcacaacgacgacgagcaguacgccugggaguccuccgccggcggcuccuucaccguccgcgccgaccacggcgagcccaucggccgcggcaccaaggucauccuccaccucaaggaggaccagaccgaguaccucgaggagcgccgcgucaaggaggucgucaagaagcacucccaguucaucggcuaccccaucacccucuaccucgagaaggagcgcgagaaggagaucuccgacgacgaggccgaggaggagaagggcgagaaggaggaggaggacaaggacgacgaggagaagcccaagaucgaggacgucggcuccgacgaggaggacgacuccggcaaggacaagaagaagaagaccaagaagaucaaggagaaguacaucgaccaggaggagcucaacaagaccaagcccaucuggacccgcaaccccgacgacaucacccaggaggaguacggcgaguucuacaagucccucaccaacgacugggaggaccaccucgccgucaagcacuucuccgucgagggccagcucgaguuccgcgcccuccucuucaucccccgccgcgcccccuucgaccucuucgagaacaagaagaagaagaacaacaucaagcucuacguccgccgcgucuucaucauggacuccugcgacgagcucauccccgaguaccucaacuucauccgcggcgucgucgacuccgaggaccucccccucaacaucucccgcgagaugcuccagcaguccaagauccucaaggucauccgcaagaacaucgucaagaagugccucgagcucuucuccgagcucgccgaggacaaggagaacuacaagaaguucuacgaggccuucuccaagaaccucaagcucggcauccacgaggacuccaccaaccgccgccgccucuccgagcuccuccgcuaccacaccucccaguccggcgacgagaugaccucccucuccgaguacgucucccgcaugaaggagacccagaaguccaucuacuacaucaccggcgaguccaaggagcaggucgccaacuccgccuucgucgagcgcguccgcaagcgcggcuucgaggucgucuacaugaccgagcccaucgacgaguacugcguccagcagcucaaggaguucgacggcaagucccucgucuccgucaccaaggagggccucgagcuccccgaggacgaggaggagaagaagaagauggaggaguccaaggccaaguucgagaaccucugcaagcucaugaaggagauccucgacaagaaggucgagaaggucaccaucuccaaccgccucgucuccucccccugcugcaucgucaccuccaccuacggcuggaccgccaacauggagcgcaucaugaaggcccaggcccuccgcgacaacuccaccaugggcuacaugauggccaagaagcaccucgagaucaaccccgaccaccccaucgucgagacccuccgccagaaggccgaggccgacaagaacgacaaggccgucaaggaccucgucguccuccucuucgagaccgcccuccucuccuccggcuucucccucgaggacccccagacccacuccaaccgcaucuaccgcaugaucaagcucggccucggcaucgacgaggacgaggucgccgccgaggagcccaacgccgccguccccgacgagauccccccccucgagggcgacgaggacgccucccgcauggaggaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4060 - RNA, 2759 nt, Artificial Sequence
  mRNA product Design3 comprising derived and/or modified sequence from Homo sapiens__NP_003290.1__HsHSP90B1 (opt2)
gggagagucccgcagucggcguccagcggcucugcuuguucgugugugugucguugcaggccuuauucaagcuuaccaugcgcgcccucuggguccucggccucugcugcguccuccucaccuucggcuccguccgcgccgacgacgaggucgacgucgacggcaccgucgaggaggaccucggcaagucccgcgagggcucccgcaccgacgacgaggucguccagcgcgaggaggaggccauccagcucgacggccucaacgccucccagauccgcgagcuccgcgagaaguccgagaaguucgccuuccaggccgaggucaaccgcaugaugaagcucaucaucaacucccucuacaagaacaaggagaucuuccuccgcgagcucaucuccaacgccuccgacgcccucgacaagauccgccucaucucccucaccgacgagaacgcccucuccggcaacgaggagcucaccgucaagaucaagugcgacaaggagaagaaccuccuccacgucaccgacaccggcgucggcaugacccgcgaggagcucgucaagaaccucggcaccaucgccaaguccggcaccuccgaguuccucaacaagaugaccgaggcccaggaggacggccaguccaccuccgagcucaucggccaguucggcgucggcuucuacuccgccuuccucgucgccgacaaggucaucgucaccuccaagcacaacaacgacacccagcacaucugggaguccgacuccaacgaguucuccgucaucgccgacccccgcggcaacacccucggccgcggcaccaccaucacccucguccucaaggaggaggccuccgacuaccucgagcucgacaccaucaagaaccucgucaagaaguacucccaguucaucaacuuccccaucuacgucugguccuccaagaccgagaccgucgaggagcccauggaggaggaggaggccgccaaggaggagaaggaggaguccgacgacgaggccgccgucgaggaggaggaggaggagaagaagcccaagaccaagaaggucgagaagaccgucugggacugggagcucaugaacgacaucaagcccaucuggcagcgccccuccaaggaggucgaggaggacgaguacaaggccuucuacaaguccuucuccaaggaguccgacgaccccauggccuacauccacuucaccgccgagggcgaggucaccuucaaguccauccucuucguccccaccuccgccccccgcggccucuucgacgaguacggcuccaagaaguccgacuacaucaagcucuacguccgccgcgucuucaucaccgacgacuuccacgacaugaugcccaaguaccucaacuucgucaagggcgucgucgacuccgacgaccucccccucaacgucucccgcgagacccuccagcagcacaagcuccucaaggucauccgcaagaagcucguccgcaagacccucgacaugaucaagaagaucgccgacgacaaguacaacgacaccuucuggaaggaguucggcaccaacaucaagcucggcgucaucgaggaccacuccaaccgcacccgccucgccaagcuccuccgcuuccaguccucccaccaccccaccgacaucaccucccucgaccaguacgucgagcgcaugaaggagaagcaggacaagaucuacuucauggccggcuccucccgcaaggaggccgaguccucccccuucgucgagcgccuccucaagaagggcuacgaggucaucuaccucaccgagcccgucgacgaguacugcauccaggcccuccccgaguucgacggcaagcgcuuccagaacgucgccaaggagggcgucaaguucgacgaguccgagaagaccaaggagucccgcgaggccgucgagaaggaguucgagccccuccucaacuggaugaaggacaaggcccucaaggacaagaucgagaaggccgucgucucccagcgccucaccgagucccccugcgcccucgucgccucccaguacggcugguccggcaacauggagcgcaucaugaaggcccaggccuaccagaccggcaaggacaucuccaccaacuacuacgccucccagaagaagaccuucgagaucaacccccgccacccccucauccgcgacaugcuccgccgcaucaaggaggacgaggacgacaagaccguccucgaccucgccgucguccucuucgagaccgccacccuccgcuccggcuaccuccuccccgacaccaaggccuacggcgaccgcaucgagcgcaugcuccgccucucccucaacaucgaccccgacgccaaggucgaggaggagcccgaggaggagcccgaggagaccgccgaggacaccaccgaggacaccgagcaggacgaggacgaggagauggacgucggcaccgacgaggaggaggagaccgccaaggaguccaccgccgagaaggacgagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4061 - RNA, 2462 nt, Artificial Sequence
  mRNA product Design3 comprising derived and/or modified sequence from Homo sapiens__NP_057376.2__HsTRAP1 (opt2)
gggagagucccgcagucggcguccagcggcucugcuuguucgugugugugucguugcaggccuuauucaagcuuaccauggcccgcgagcuccgcgcccuccuccucuggggccgccgccuccgcccccuccuccgcgcccccgcccucgccgccguccccggcggcaagcccauccucugcccccgccgcaccaccgcccagcucggcccccgccgcaaccccgccuggucccuccaggccggccgccucuucuccacccagaccgccgaggacaaggaggagccccuccacuccaucaucuccuccaccgaguccguccagggcuccaccuccaagcacgaguuccaggccgagaccaagaagcuccucgacaucgucgcccgcucccucuacuccgagaaggaggucuucauccgcgagcucaucuccaacgccuccgacgcccucgagaagcuccgccacaagcucgucuccgacggccaggcccuccccgagauggagauccaccuccagaccaacgccgagaagggcaccaucaccauccaggacaccggcaucggcaugacccaggaggagcucgucuccaaccucggcaccaucgcccgcuccggcuccaaggccuuccucgacgcccuccagaaccaggccgaggccuccuccaagaucaucggccaguucggcgucggcuucuacuccgccuucauggucgccgaccgcgucgaggucuacucccgcuccgccgcccccggcucccucggcuaccaguggcucuccgacggcuccggcgucuucgagaucgccgaggccuccggcguccgcaccggcaccaagaucaucauccaccucaaguccgacugcaaggaguucuccuccgaggcccgcguccgcgacgucgucaccaaguacuccaacuucgucuccuucccccucuaccucaacggccgccgcaugaacacccuccaggccaucuggaugauggaccccaaggacguccgcgaguggcagcacgaggaguucuaccgcuacgucgcccaggcccacgacaagccccgcuacacccuccacuacaagaccgacgccccccucaacauccgcuccaucuucuacguccccgacaugaagcccuccauguucgacgucucccgcgagcucggcuccuccgucgcccucuacucccgcaagguccucauccagaccaaggccaccgacauccuccccaaguggcuccgcuucauccgcggcgucgucgacuccgaggacaucccccucaaccucucccgcgagcuccuccaggaguccgcccucauccgcaagcuccgcgacguccuccagcagcgccucaucaaguucuucaucgaccaguccaagaaggacgccgagaaguacgccaaguucuucgaggacuacggccucuucaugcgcgagggcaucgucaccgccaccgagcaggaggucaaggaggacaucgccaagcuccuccgcuacgaguccuccgcccuccccuccggccagcucaccucccucuccgaguacgccucccgcaugcgcgccggcacccgcaacaucuacuaccucugcgcccccaaccgccaccucgccgagcacucccccuacuacgaggccaugaagaagaaggacaccgagguccucuucugcuucgagcaguucgacgagcucacccuccuccaccuccgcgaguucgacaagaagaagcucaucuccgucgagaccgacaucgucgucgaccacuacaaggaggagaaguucgaggaccgcucccccgccgccgagugccucuccgagaaggagaccgaggagcucauggccuggaugcgcaacguccucggcucccgcgucaccaacgucaaggucacccuccgccucgacacccaccccgccauggucaccguccucgagaugggcgccgcccgccacuuccuccgcaugcagcagcucgccaagacccaggaggagcgcgcccagcuccuccagcccacccucgagaucaacccccgccacgcccucaucaagaagcucaaccagcuccgcgccuccgagcccggccucgcccagcuccucgucgaccagaucuacgagaacgccaugaucgccgccggccucgucgacgacccccgcgccauggucggccgccucaacgagcuccucgucaaggcccucgagcgccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4062 - RNA, 809 nt, Artificial Sequence
  mRNA product Design3 comprising derived and/or modified sequence from Homo sapiens__NP_000609.1__HsIGF1 (opt2)
gggagagucccgcagucggcguccagcggcucugcuuguucgugugugugucguugcaggccuuauucaagcuuaccaugggcaagaucuccucccuccccacccagcucuucaagugcugcuucugcgacuuccucaaggucaagaugcacaccauguccuccucccaccucuucuaccucgcccucugccuccucaccuucaccuccuccgccaccgccggccccgagacccucugcggcgccgagcucgucgacgcccuccaguucgucugcggcgaccgcggcuucuacuucaacaagcccaccggcuacggcuccuccucccgccgcgccccccagaccggcaucgucgacgagugcugcuuccgcuccugcgaccuccgccgccucgagauguacugcgccccccucaagcccgccaaguccgcccgcuccguccgcgcccagcgccacaccgacaugcccaagacccagaaggagguccaccucaagaacgccucccgcggcuccgccggcaacaagaacuaccgcaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4063 - RNA, 890 nt, Artificial Sequence
  mRNA product Design3 comprising derived and/or modified sequence from Homo sapiens__NP_000603.1__HsIGF2 (opt2)
gggagagucccgcagucggcguccagcggcucugcuuguucgugugugugucguugcaggccuuauucaagcuuaccaugggcauccccaugggcaaguccaugcucguccuccucaccuuccucgccuucgccuccugcugcaucgccgccuaccgccccuccgagacccucugcggcggcgagcucgucgacacccuccaguucgucugcggcgaccgcggcuucuacuucucccgccccgccucccgcgucucccgccgcucccgcggcaucgucgaggagugcugcuuccgcuccugcgaccucgcccuccucgagaccuacugcgccacccccgccaaguccgagcgcgacgucuccaccccccccaccguccuccccgacaacuucccccgcuaccccgucggcaaguucuuccaguacgacaccuggaagcaguccacccagcgccuccgccgcggccuccccgcccuccuccgcgcccgccgcggccacguccucgccaaggagcucgaggccuuccgcgaggccaagcgccaccgcccccucaucgcccuccccacccaggaccccgcccacggcggcgccccccccgagauggccuccaaccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4064 - RNA, 986 nt, Artificial Sequence
  mRNA product Design3 comprising derived and/or modified sequence from Homo sapiens__NP_000591.1__HsIL6 (opt2)
gggagagucccgcagucggcguccagcggcucugcuuguucgugugugugucguugcaggccuuauucaagcuuaccaugaacuccuucuccaccuccgccuucggccccgucgccuucucccucggccuccuccucguccuccccgccgccuuccccgcccccgucccccccggcgaggacuccaaggacgucgccgccccccaccgccagccccucaccuccuccgagcgcaucgacaagcagauccgcuacauccucgacggcaucuccgcccuccgcaaggagaccugcaacaaguccaacaugugcgaguccuccaaggaggcccucgccgagaacaaccucaaccuccccaagauggccgagaaggacggcugcuuccaguccggcuucaacgaggagaccugccucgucaagaucaucaccggccuccucgaguucgaggucuaccucgaguaccuccagaaccgcuucgaguccuccgaggagcaggcccgcgccguccagauguccaccaagguccucauccaguuccuccagaagaaggccaagaaccucgacgccaucaccacccccgaccccaccaccaacgccucccuccucaccaagcuccaggcccagaaccaguggcuccaggacaugaccacccaccucauccuccgcuccuucaaggaguuccuccaguccucccuccgcgcccuccgccagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4065 - RNA, 1628 nt, Artificial Sequence
  mRNA product Design3 comprising derived and/or modified sequence from Homo sapiens__NP_002183.1__HsINHBA (opt2)
gggagagucccgcagucggcguccagcggcucugcuuguucgugugugugucguugcaggccuuauucaagcuuaccaugccccuccucuggcuccgcggcuuccuccucgccuccugcuggaucaucguccgcuccucccccacccccggcuccgagggccacuccgccgcccccgacugccccuccugcgcccucgccgcccuccccaaggacguccccaacucccagcccgagauggucgaggccgucaagaagcacauccucaacaugcuccaccucaagaagcgccccgacgucacccagcccguccccaaggccgcccuccucaacgccauccgcaagcuccacgucggcaaggucggcgagaacggcuacgucgagaucgaggacgacaucggccgccgcgccgagaugaacgagcucauggagcagaccuccgagaucaucaccuucgccgaguccggcaccgcccgcaagacccuccacuucgagaucuccaaggagggcuccgaccucuccgucgucgagcgcgccgaggucuggcucuuccucaagguccccaaggccaaccgcacccgcaccaaggucaccauccgccucuuccagcagcagaagcacccccagggcucccucgacaccggcgaggaggccgaggaggucggccucaagggcgagcgcuccgagcuccuccucuccgagaaggucgucgacgcccgcaaguccaccuggcacgucuuccccgucuccuccuccauccagcgccuccucgaccagggcaaguccucccucgacguccgcaucgccugcgagcagugccaggaguccggcgccucccucguccuccucggcaagaagaagaagaaggaggaggagggcgagggcaagaagaagggcggcggcgagggcggcgccggcgccgacgaggagaaggagcagucccaccgccccuuccucaugcuccaggcccgccaguccgaggaccacccccaccgccgccgccgccgcggccucgagugcgacggcaaggucaacaucugcugcaagaagcaguucuucgucuccuucaaggacaucggcuggaacgacuggaucaucgcccccuccggcuaccacgccaacuacugcgagggcgagugccccucccacaucgccggcaccuccggcuccucccucuccuuccacuccaccgucaucaaccacuaccgcaugcgcggccacucccccuucgccaaccucaaguccugcugcguccccaccaagcuccgccccauguccaugcucuacuacgacgacggccagaacaucaucaagaaggacauccagaacaugaucgucgaggagugcggcugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4066 - RNA, 1571 nt, Artificial Sequence
  mRNA product Design3 comprising derived and/or modified sequence from Homo sapiens__NP_002184.2__HsINHBB (opt2)
gggagagucccgcagucggcguccagcggcucugcuuguucgugugugugucguugcaggccuuauucaagcuuaccauggacggccuccccggccgcgcccucggcgccgccugccuccuccuccucgccgccggcuggcucggccccgaggccuggggcucccccacccccccccccacccccgccgcccccccccccccccccccccccggcucccccggcggcucccaggacaccugcaccuccugcggcggcuuccgccgccccgaggagcucggccgcgucgacggcgacuuccucgaggccgucaagcgccacauccucucccgccuccagaugcgcggccgccccaacaucacccacgccguccccaaggccgccauggucaccgcccuccgcaagcuccacgccggcaagguccgcgaggacggccgcgucgagaucccccaccucgacggccacgccucccccggcgccgacggccaggagcgcgucuccgagaucaucuccuucgccgagaccgacggccucgccuccucccgcguccgccucuacuucuucaucuccaacgagggcaaccagaaccucuucgucguccaggccucccucuggcucuaccucaagcuccuccccuacguccucgagaagggcucccgccgcaagguccgcgucaaggucuacuuccaggagcagggccacggcgaccgcuggaacauggucgagaagcgcgucgaccucaagcgcuccggcuggcacaccuucccccucaccgaggccauccaggcccucuucgagcgcggcgagcgccgccucaaccucgacguccagugcgacuccugccaggagcucgccgucguccccgucuucgucgaccccggcgaggagucccaccgccccuucgucgucguccaggcccgccucggcgacucccgccaccgcauccgcaagcgcggccucgagugcgacggccgcaccaaccucugcugccgccagcaguucuucaucgacuuccgccucaucggcuggaacgacuggaucaucgcccccaccggcuacuacggcaacuacugcgagggcuccugccccgccuaccucgccggcguccccggcuccgccuccuccuuccacaccgccgucgucaaccaguaccgcaugcgcggccucaaccccggcaccgucaacuccugcugcauccccaccaagcucuccaccauguccaugcucuacuucgacgacgaguacaacaucgucaagcgcgacguccccaacaugaucgucgaggagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4067 - RNA, 3806 nt, Artificial Sequence
  mRNA product Design3 comprising derived and/or modified sequence from Homo sapiens__NP_000623.2__HsITGAM (opt2)
gggagagucccgcagucggcguccagcggcucugcuuguucgugugugugucguugcaggccuuauucaagcuuaccauggcccuccgcguccuccuccucaccgcccucacccucugccacggcuucaaccucgacaccgagaacgccaugaccuuccaggagaacgcccgcggcuucggccaguccgucguccagcuccagggcucccgcgucgucgucggcgccccccaggagaucgucgccgccaaccagcgcggcucccucuaccagugcgacuacuccaccggcuccugcgagcccauccgccuccagguccccgucgaggccgucaacaugucccucggccucucccucgccgccaccaccucccccccccagcuccucgccugcggccccaccguccaccagaccugcuccgagaacaccuacgucaagggccucugcuuccucuucggcuccaaccuccgccagcagccccagaaguuccccgaggcccuccgcggcugcccccaggaggacuccgacaucgccuuccucaucgacggcuccggcuccaucaucccccacgacuuccgccgcaugaaggaguucgucuccaccgucauggagcagcucaagaaguccaagacccucuucucccucaugcaguacuccgaggaguuccgcauccacuucaccuucaaggaguuccagaacaaccccaacccccgcucccucgucaagcccaucacccagcuccucggccgcacccacaccgccaccggcauccgcaaggucguccgcgagcucuucaacaucaccaacggcgcccgcaagaacgccuucaagauccucgucgucaucaccgacggcgagaaguucggcgacccccucggcuacgaggacgucauccccgaggccgaccgcgagggcgucauccgcuacgucaucggcgucggcgacgccuuccgcuccgagaagucccgccaggagcucaacaccaucgccuccaagcccccccgcgaccacgucuuccaggucaacaacuucgaggcccucaagaccauccagaaccagcuccgcgagaagaucuucgccaucgagggcacccagaccggcuccuccuccuccuucgagcacgagaugucccaggagggcuucuccgccgccaucaccuccaacggcccccuccucuccaccgucggcuccuacgacugggccggcggcgucuuccucuacaccuccaaggagaaguccaccuucaucaacaugacccgcgucgacuccgacaugaacgacgccuaccucggcuacgccgccgccaucauccuccgcaaccgcguccagucccucguccucggcgccccccgcuaccagcacaucggccucgucgccauguuccgccagaacaccggcaugugggaguccaacgccaacgucaagggcacccagaucggcgccuacuucggcgccucccucugcuccgucgacgucgacuccaacggcuccaccgaccucguccucaucggcgccccccacuacuacgagcagacccgcggcggccaggucuccgucugcccccucccccgcggccgcgcccgcuggcagugcgacgccguccucuacggcgagcagggccagcccuggggccgcuucggcgccgcccucaccguccucggcgacgucaacggcgacaagcucaccgacgucgccaucggcgcccccggcgaggaggacaaccgcggcgccgucuaccucuuccacggcaccuccggcuccggcaucucccccucccacucccagcgcaucgccggcuccaagcucuccccccgccuccaguacuucggccagucccucuccggcggccaggaccucaccauggacggccucgucgaccucaccgucggcgcccagggccacguccuccuccuccgcucccagcccguccuccgcgucaaggccaucauggaguucaacccccgcgaggucgcccgcaacgucuucgagugcaacgaccaggucgucaagggcaaggaggccggcgagguccgcgucugccuccacguccagaaguccacccgcgaccgccuccgcgagggccagauccaguccgucgucaccuacgaccucgcccucgacuccggccgcccccacucccgcgccgucuucaacgagaccaagaacuccacccgccgccagacccagguccucggccucacccagaccugcgagacccucaagcuccagcuccccaacugcaucgaggaccccgucucccccaucguccuccgccucaacuucucccucgucggcaccccccucuccgccuucggcaaccuccgccccguccucgccgaggacgcccagcgccucuucaccgcccucuuccccuucgagaagaacugcggcaacgacaacaucugccaggacgaccucuccaucaccuucuccuucaugucccucgacugccucgucgucggcggcccccgcgaguucaacgucaccgucaccguccgcaacgacggcgaggacuccuaccgcacccaggucaccuucuucuucccccucgaccucuccuaccgcaaggucuccacccuccagaaccagcgcucccagcgcuccuggcgccucgccugcgaguccgccuccuccaccgaggucuccggcgcccucaaguccaccuccugcuccaucaaccaccccaucuuccccgagaacuccgaggucaccuucaacaucaccuucgacgucgacuccaaggccucccucggcaacaagcuccuccucaaggccaacgucaccuccgagaacaacaugccccgcaccaacaagaccgaguuccagcucgagcuccccgucaaguacgccgucuacauggucgucaccucccacggcgucuccaccaaguaccucaacuucaccgccuccgagaacaccucccgcgucaugcagcaccaguaccaggucuccaaccucggccagcgcucccuccccaucucccucgucuuccucguccccguccgccucaaccagaccgucaucugggaccgcccccaggucaccuucuccgagaaccucuccuccaccugccacaccaaggagcgccuccccucccacuccgacuuccucgccgagcuccgcaaggcccccgucgucaacugcuccaucgccgucugccagcgcauccagugcgacauccccuucuucggcauccaggaggaguucaacgccacccucaagggcaaccucuccuucgacugguacaucaagaccucccacaaccaccuccucaucgucuccaccgccgagauccucuucaacgacuccgucuucacccuccuccccggccagggcgccuucguccgcucccagaccgagaccaaggucgagcccuucgagguccccaacccccucccccucaucgucggcuccuccgucggcggccuccuccuccucgcccucaucaccgccgcccucuacaagcucggcuucuucaagcgccaguacaaggacaugauguccgagggcggcccccccggcgccgagccccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4068 - RNA, 1751 nt, Artificial Sequence
  mRNA product Design3 comprising derived and/or modified sequence from Homo sapiens__NP_002415.1__HsMMP8 (opt2)
gggagagucccgcagucggcguccagcggcucugcuuguucgugugugugucguugcaggccuuauucaagcuuaccauguucucccucaagacccuccccuuccuccuccuccuccacguccagaucuccaaggccuuccccgucuccuccaaggagaagaacaccaagaccguccaggacuaccucgagaaguucuaccagcuccccuccaaccaguaccaguccacccgcaagaacggcaccaacgucaucgucgagaagcucaaggagaugcagcgcuucuucggccucaacgucaccggcaagcccaacgaggagacccucgacaugaugaagaagccccgcugcggcguccccgacuccggcggcuucaugcucacccccggcaaccccaagugggagcgcaccaaccucaccuaccgcauccgcaacuacaccccccagcucuccgaggccgaggucgagcgcgccaucaaggacgccuucgagcucugguccgucgccuccccccucaucuucacccgcaucucccagggcgaggccgacaucaacaucgccuucuaccagcgcgaccacggcgacaacucccccuucgacggccccaacggcauccucgcccacgccuuccagcccggccagggcaucggcggcgacgcccacuucgacgccgaggagaccuggaccaacaccuccgccaacuacaaccucuuccucgucgccgcccacgaguucggccacucccucggccucgcccacuccuccgaccccggcgcccucauguaccccaacuacgccuuccgcgagaccuccaacuacucccucccccaggacgacaucgacggcauccaggccaucuacggccucuccuccaaccccauccagcccaccggccccuccacccccaagcccugcgaccccucccucaccuucgacgccaucaccacccuccgcggcgagauccucuucuucaaggaccgcuacuucuggcgccgccacccccagcuccagcgcgucgagaugaacuucaucucccucuucuggcccucccuccccaccggcauccaggccgccuacgaggacuucgaccgcgaccucaucuuccucuucaagggcaaccaguacugggcccucuccggcuacgacauccuccagggcuaccccaaggacaucuccaacuacggcuuccccuccuccguccaggccaucgacgccgccgucuucuaccgcuccaagaccuacuucuucgucaacgaccaguucuggcgcuacgacaaccagcgccaguucauggagcccggcuaccccaaguccaucuccggcgccuuccccggcaucgaguccaaggucgacgccgucuuccagcaggagcacuucuuccacgucuucuccggcccccgcuacuacgccuucgaccucaucgcccagcgcgucacccgcgucgcccgcggcaacaaguggcucaacugccgcuacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4069 - RNA, 2471 nt, Artificial Sequence
  mRNA product Design3 comprising derived and/or modified sequence from Homo sapiens__NP_004985.2__HsMMP9 (opt2)
gggagagucccgcagucggcguccagcggcucugcuuguucgugugugugucguugcaggccuuauucaagcuuaccaugucccucuggcagccccucguccucguccuccucguccucggcugcugcuucgccgccccccgccagcgccaguccacccucguccucuuccccggcgaccuccgcaccaaccucaccgaccgccagcucgccgaggaguaccucuaccgcuacggcuacacccgcgucgccgagaugcgcggcgaguccaagucccucggccccgcccuccuccuccuccagaagcagcucucccuccccgagaccggcgagcucgacuccgccacccucaaggccaugcgcaccccccgcugcggcguccccgaccucggccgcuuccagaccuucgagggcgaccucaaguggcaccaccacaacaucaccuacuggauccagaacuacuccgaggaccucccccgcgccgucaucgacgacgccuucgcccgcgccuucgcccucugguccgccgucaccccccucaccuucacccgcgucuacucccgcgacgccgacaucgucauccaguucggcgucgccgagcacggcgacggcuaccccuucgacggcaaggacggccuccucgcccacgccuucccccccggccccggcauccagggcgacgcccacuucgacgacgacgagcucuggucccucggcaagggcgucgucguccccacccgcuucggcaacgccgacggcgccgccugccacuuccccuucaucuucgagggccgcuccuacuccgccugcaccaccgacggccgcuccgacggccuccccuggugcuccaccaccgccaacuacgacaccgacgaccgcuucggcuucugccccuccgagcgccucuacacccaggacggcaacgccgacggcaagcccugccaguuccccuucaucuuccagggccaguccuacuccgccugcaccaccgacggccgcuccgacggcuaccgcuggugcgccaccaccgccaacuacgaccgcgacaagcucuucggcuucugccccacccgcgccgacuccaccgucaugggcggcaacuccgccggcgagcucugcgucuuccccuucaccuuccucggcaaggaguacuccaccugcaccuccgagggccgcggcgacggccgccucuggugcgccaccaccuccaacuucgacuccgacaagaaguggggcuucugccccgaccagggcuacucccucuuccucgucgccgcccacgaguucggccacgcccucggccucgaccacuccuccguccccgaggcccucauguaccccauguaccgcuucaccgagggccccccccuccacaaggacgacgucaacggcauccgccaccucuacggcccccgccccgagcccgagccccgcccccccaccaccaccaccccccagcccaccgccccccccaccgucugccccaccggcccccccaccguccaccccuccgagcgccccaccgccggccccaccggcccccccuccgccggccccaccggcccccccaccgccggccccuccaccgccaccaccgucccccucucccccgucgacgacgccugcaacgucaacaucuucgacgccaucgccgagaucggcaaccagcucuaccucuucaaggacggcaaguacuggcgcuucuccgagggccgcggcucccgcccccagggccccuuccucaucgccgacaaguggcccgcccucccccgcaagcucgacuccgucuucgaggagcgccucuccaagaagcucuucuucuucuccggccgccaggucugggucuacaccggcgccuccguccucggcccccgccgccucgacaagcucggccucggcgccgacgucgcccaggucaccggcgcccuccgcuccggccgcggcaagaugcuccucuucuccggccgccgccucuggcgcuucgacgucaaggcccagauggucgacccccgcuccgccuccgaggucgaccgcauguuccccggcgucccccucgacacccacgacgucuuccaguaccgcgagaaggccuacuucugccaggaccgcuucuacuggcgcgucuccucccgcuccgagcucaaccaggucgaccaggucggcuacgucaccuacgacauccuccagugccccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4070 - RNA, 1763 nt, Artificial Sequence
  mRNA product Design3 comprising derived and/or modified sequence from Homo sapiens__NP_002418.1__HsMMP13 (opt2)
gggagagucccgcagucggcguccagcggcucugcuuguucgugugugugucguugcaggccuuauucaagcuuaccaugcaccccggcguccucgccgccuuccucuuccucuccuggacccacugccgcgcccucccccuccccuccggcggcgacgaggacgaccucuccgaggaggaccuccaguucgccgagcgcuaccuccgcuccuacuaccaccccaccaaccucgccggcauccucaaggagaacgccgccuccuccaugaccgagcgccuccgcgagaugcaguccuucuucggccucgaggucaccggcaagcucgacgacaacacccucgacgucaugaagaagccccgcugcggcguccccgacgucggcgaguacaacgucuucccccgcacccucaagugguccaagaugaaccucaccuaccgcaucgucaacuacacccccgacaugacccacuccgaggucgagaaggccuucaagaaggccuucaaggucugguccgacgucaccccccucaacuucacccgccuccacgacggcaucgccgacaucaugaucuccuucggcaucaaggagcacggcgacuucuaccccuucgacggccccuccggccuccucgcccacgccuucccccccggccccaacuacggcggcgacgcccacuucgacgacgacgagaccuggaccuccuccuccaagggcuacaaccucuuccucgucgccgcccacgaguucggccacucccucggccucgaccacuccaaggaccccggcgcccucauguuccccaucuacaccuacaccggcaagucccacuucaugcuccccgacgacgacguccagggcauccagucccucuacggccccggcgacgaggaccccaaccccaagcaccccaagacccccgacaagugcgaccccucccucucccucgacgccaucaccucccuccgcggcgagaccaugaucuucaaggaccgcuucuucuggcgccuccacccccagcaggucgacgccgagcucuuccucaccaaguccuucuggcccgagcuccccaaccgcaucgacgccgccuacgagcaccccucccacgaccucaucuucaucuuccgcggccgcaaguucugggcccucaacggcuacgacauccucgagggcuaccccaagaagaucuccgagcucggccuccccaaggaggucaagaagaucuccgccgccguccacuucgaggacaccggcaagacccuccucuucuccggcaaccaggucuggcgcuacgacgacaccaaccacaucauggacaaggacuacccccgccucaucgaggaggacuuccccggcaucggcgacaaggucgacgccgucuacgagaagaacggcuacaucuacuucuucaacggccccauccaguucgaguacuccaucugguccaaccgcaucguccgcgucaugcccgccaacuccauccucuggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4071 - RNA, 1415 nt, Artificial Sequence
  mRNA product Design3 comprising derived and/or modified sequence from Homo sapiens__NP_001286.1__HsCCR1 (opt2)
gggagagucccgcagucggcguccagcggcucugcuuguucgugugugugucguugcaggccuuauucaagcuuaccauggagacccccaacaccaccgaggacuacgacaccaccaccgaguucgacuacggcgacgccacccccugccagaaggucaacgagcgcgccuucggcgcccagcuccuccccccccucuacucccucgucuucgucaucggccucgucggcaacauccucgucguccucguccucguccaguacaagcgccucaagaacaugaccuccaucuaccuccucaaccucgccaucuccgaccuccucuuccucuucacccuccccuucuggaucgacuacaagcucaaggacgacugggucuucggcgacgccaugugcaagauccucuccggcuucuacuacaccggccucuacuccgagaucuucuucaucauccuccucaccaucgaccgcuaccucgccaucguccacgccgucuucgcccuccgcgcccgcaccgucaccuucggcgucaucaccuccaucaucaucugggcccucgccauccucgccuccaugcccggccucuacuucuccaagacccagugggaguucacccaccacaccugcucccuccacuucccccacgagucccuccgcgaguggaagcucuuccaggcccucaagcucaaccucuucggccucguccucccccuccucgucaugaucaucugcuacaccggcaucaucaagauccuccuccgccgccccaacgagaagaaguccaaggccguccgccucaucuucgucaucaugaucaucuucuuccucuucuggacccccuacaaccucaccauccucaucuccgucuuccaggacuuccucuucacccacgagugcgagcagucccgccaccucgaccucgccguccaggucaccgaggucaucgccuacacccacugcugcgucaaccccgucaucuacgccuucgucggcgagcgcuuccgcaaguaccuccgccagcucuuccaccgccgcgucgccguccaccucgucaaguggcuccccuuccucuccgucgaccgccucgagcgcgucuccuccaccucccccuccaccggcgagcacgagcucuccgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4072 - RNA, 983 nt, Artificial Sequence
  mRNA product Design3 comprising derived and/or modified sequence from Homo sapiens__NP_002598.4__HsPDGFA (opt2)
gggagagucccgcagucggcguccagcggcucugcuuguucgugugugugucguugcaggccuuauucaagcuuaccaugcgcacccucgccugccuccuccuccucggcugcggcuaccucgcccacguccucgccgaggaggccgagaucccccgcgaggucaucgagcgccucgcccgcucccagauccacuccauccgcgaccuccagcgccuccucgagaucgacuccgucggcuccgaggacucccucgacaccucccuccgcgcccacggcguccacgccaccaagcacguccccgagaagcgcccccuccccauccgccgcaagcgcuccaucgaggaggccguccccgccgucugcaagacccgcaccgucaucuacgagaucccccgcucccaggucgaccccaccuccgccaacuuccucaucuggccccccugcgucgaggucaagcgcugcaccggcugcugcaacaccuccuccgucaagugccagcccucccgcguccaccaccgcuccgucaaggucgccaaggucgaguacguccgcaagaagcccaagcucaaggagguccagguccgccucgaggagcaccucgagugcgccugcgccaccaccucccucaaccccgacuaccgcgaggaggacaccggccgcccccgcgaguccggcaagaagcgcaagcgcaagcgccucaagcccaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4073 - RNA, 1073 nt, Artificial Sequence
  mRNA product Design3 comprising derived and/or modified sequence from Homo sapiens__NP_002599.1__HsPDGFB (opt2)
gggagagucccgcagucggcguccagcggcucugcuuguucgugugugugucguugcaggccuuauucaagcuuaccaugaaccgcugcugggcccucuuccucucccucugcugcuaccuccgccucgucuccgccgagggcgaccccauccccgaggagcucuacgagaugcucuccgaccacuccauccgcuccuucgacgaccuccagcgccuccuccacggcgaccccggcgaggaggacggcgccgagcucgaccucaacaugacccgcucccacuccggcggcgagcucgagucccucgcccgcggccgccgcucccucggcucccucaccaucgccgagcccgccaugaucgccgagugcaagacccgcaccgaggucuucgagaucucccgccgccucaucgaccgcaccaacgccaacuuccucgucuggccccccugcgucgagguccagcgcugcuccggcugcugcaacaaccgcaacguccagugccgccccacccagguccagcuccgccccguccagguccgcaagaucgagaucguccgcaagaagcccaucuucaagaaggccaccgucacccucgaggaccaccucgccugcaagugcgagaccgucgccgccgcccgccccgucacccgcucccccggcggcucccaggagcagcgcgccaagaccccccagacccgcgucaccauccgcaccguccgcguccgccgcccccccaagggcaagcaccgcaaguucaagcacacccacgacaagaccgcccucaaggagacccucggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4074 - RNA, 1385 nt, Artificial Sequence
  mRNA product Design3 comprising derived and/or modified sequence from Homo sapiens__NP_057289.1__HsPDGFC (opt2)
gggagagucccgcagucggcguccagcggcucugcuuguucgugugugugucguugcaggccuuauucaagcuuaccaugucccucuucggccuccuccuccucaccuccgcccucgccggccagcgccagggcacccaggccgaguccaaccucuccuccaaguuccaguucuccuccaacaaggagcagaacggcguccaggacccccagcacgagcgcaucaucaccgucuccaccaacggcuccauccacuccccccgcuucccccacaccuacccccgcaacaccguccucgucuggcgccucgucgccgucgaggagaacgucuggauccagcucaccuucgacgagcgcuucggccucgaggaccccgaggacgacaucugcaaguacgacuucgucgaggucgaggagcccuccgacggcaccauccucggccgcuggugcggcuccggcaccguccccggcaagcagaucuccaagggcaaccagauccgcauccgcuucgucuccgacgaguacuuccccuccgagcccggcuucugcauccacuacaacaucgucaugccccaguucaccgaggccgucucccccuccguccucccccccuccgcccucccccucgaccuccucaacaacgccaucaccgccuucuccacccucgaggaccucauccgcuaccucgagcccgagcgcuggcagcucgaccucgaggaccucuaccgccccaccuggcagcuccucggcaaggccuucgucuucggccgcaagucccgcgucgucgaccucaaccuccucaccgaggagguccgccucuacuccugcaccccccgcaacuucuccgucuccauccgcgaggagcucaagcgcaccgacaccaucuucuggcccggcugccuccucgucaagcgcugcggcggcaacugcgccugcugccuccacaacugcaacgagugccagugcguccccuccaaggucaccaagaaguaccacgagguccuccagcuccgccccaagaccggcguccgcggccuccacaagucccucaccgacgucgcccucgagcaccacgaggagugcgacugcgucugccgcggcuccaccggcggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4075 - RNA, 1442 nt, Artificial Sequence
  mRNA product Design3 comprising derived and/or modified sequence from Homo sapiens__NP_149126.1__HsPDGFD (opt2)
gggagagucccgcagucggcguccagcggcucugcuuguucgugugugugucguugcaggccuuauucaagcuuaccaugcaccgccucaucuucgucuacacccucaucugcgccaacuucugcuccugccgcgacaccuccgccaccccccaguccgccuccaucaaggcccuccgcaacgccaaccuccgccgcgacgaccucuaccgccgcgacgagaccauccaggucaagggcaacggcuacguccaguccccccgcuuccccaacuccuacccccgcaaccuccuccucaccuggcgccuccacucccaggagaacacccgcauccagcucgucuucgacaaccaguucggccucgaggaggccgagaacgacaucugccgcuacgacuucgucgaggucgaggacaucuccgagaccuccaccaucauccgcggccgcuggugcggccacaaggagguccccccccgcaucaagucccgcaccaaccagaucaagaucaccuucaaguccgacgacuacuucgucgccaagcccggcuucaagaucuacuacucccuccucgaggacuuccagcccgccgccgccuccgagaccaacugggaguccgucaccuccuccaucuccggcgucuccuacaacucccccuccgucaccgaccccacccucaucgccgacgcccucgacaagaagaucgccgaguucgacaccgucgaggaccuccucaaguacuucaaccccgaguccuggcaggaggaccucgagaacauguaccucgacaccccccgcuaccgcggccgcuccuaccacgaccgcaaguccaaggucgaccucgaccgccucaacgacgacgccaagcgcuacuccugcaccccccgcaacuacuccgucaacauccgcgaggagcucaagcucgccaacgucgucuucuucccccgcugccuccucguccagcgcugcggcggcaacugcggcugcggcaccgucaacuggcgcuccugcaccugcaacuccggcaagaccgucaagaaguaccacgagguccuccaguucgagcccggccacaucaagcgccgcggccgcgccaagaccauggcccucgucgacauccagcucgaccaccacgagcgcugcgacugcaucugcuccucccgccccccccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4076 - RNA, 1025 nt, Artificial Sequence
  mRNA product Design3 comprising derived and/or modified sequence from Homo sapiens__NP_003946.3__HsSOCS3 (opt2)
gggagagucccgcagucggcguccagcggcucugcuuguucgugugugugucguugcaggccuuauucaagcuuaccauggucacccacuccaaguuccccgccgccggcaugucccgcccccucgacaccucccuccgccucaagaccuucuccuccaaguccgaguaccagcucgucgucaacgccguccgcaagcuccaggaguccggcuucuacugguccgccgucaccggcggcgaggccaaccuccuccucuccgccgagcccgccggcaccuuccucauccgcgacuccuccgaccagcgccacuucuucacccucuccgucaagacccaguccggcaccaagaaccuccgcauccagugcgagggcggcuccuucucccuccaguccgacccccgcuccacccagcccgucccccgcuucgacugcguccucaagcucguccaccacuacaugcccccccccggcgcccccuccuuccccuccccccccaccgagcccuccuccgagguccccgagcagcccuccgcccagccccuccccggcucccccccccgccgcgccuacuacaucuacuccggcggcgagaagaucccccucguccucucccgcccccucuccuccaacgucgccacccuccagcaccucugccgcaagaccgucaacggccaccucgacuccuacgagaaggucacccagcuccccggccccauccgcgaguuccucgaccaguacgacgccccccucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4077 - RNA, 830 nt, Artificial Sequence
  mRNA product Design3 comprising derived and/or modified sequence from Homo sapiens__NP_003227.1__HsTGFA (opt2)
gggagagucccgcagucggcguccagcggcucugcuuguucgugugugugucguugcaggccuuauucaagcuuaccaugguccccuccgccggccagcucgcccucuucgcccucggcaucguccucgccgccugccaggcccucgagaacuccaccuccccccucuccgccgacccccccgucgccgccgccgucgucucccacuucaacgacugccccgacucccacacccaguucugcuuccacggcaccugccgcuuccucguccaggaggacaagcccgccugcgucugccacuccggcuacgucggcgcccgcugcgagcacgccgaccuccucgccgucgucgccgccucccagaagaagcaggccaucaccgcccucgucgucgucuccaucgucgcccucgccguccucaucaucaccugcguccucauccacugcugccagguccgcaagcacugcgaguggugccgcgcccucaucugccgccacgagaagcccuccgcccuccucaagggccgcaccgccugcugccacuccgagaccgucgucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4078 - RNA, 1520 nt, Artificial Sequence
  mRNA product Design3 comprising derived and/or modified sequence from Homo sapiens__NP_000651.3__HsTGFB1 (opt2)
gggagagucccgcagucggcguccagcggcucugcuuguucgugugugugucguugcaggccuuauucaagcuuaccaugccccccuccggccuccgccuccucccccuccuccucccccuccucuggcuccucguccucacccccggccgccccgccgccggccucuccaccugcaagaccaucgacauggagcucgucaagcgcaagcgcaucgaggccauccgcggccagauccucuccaagcuccgccucgccuccccccccucccagggcgaggucccccccggcccccuccccgaggccguccucgcccucuacaacuccacccgcgaccgcgucgccggcgaguccgccgagcccgagcccgagcccgaggccgacuacuacgccaaggaggucacccgcguccucauggucgagacccacaacgagaucuacgacaaguucaagcaguccacccacuccaucuacauguucuucaacaccuccgagcuccgcgaggccguccccgagcccguccuccucucccgcgccgagcuccgccuccuccgccucaagcucaaggucgagcagcacgucgagcucuaccagaaguacuccaacaacuccuggcgcuaccucuccaaccgccuccucgcccccuccgacucccccgaguggcucuccuucgacgucaccggcgucguccgccaguggcucucccgcggcggcgagaucgagggcuuccgccucuccgcccacugcuccugcgacucccgcgacaacacccuccaggucgacaucaacggcuucaccaccggccgccgcggcgaccucgccaccauccacggcaugaaccgccccuuccuccuccucauggccaccccccucgagcgcgcccagcaccuccaguccucccgccaccgccgcgcccucgacaccaacuacugcuucuccuccaccgagaagaacugcugcguccgccagcucuacaucgacuuccgcaaggaccucggcuggaaguggauccacgagcccaagggcuaccacgccaacuucugccucggccccugccccuacaucuggucccucgacacccaguacuccaagguccucgcccucuacaaccagcacaaccccggcgccuccgccgcccccugcugcgucccccaggcccucgagccccuccccaucgucuacuacgucggccgcaagcccaaggucgagcagcucuccaacaugaucguccgcuccugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4079 - RNA, 1592 nt, Artificial Sequence
  mRNA product Design3 comprising derived and/or modified sequence from Homo sapiens__NP_003229.1__HsTGFB2 (opt2)
gggagagucccgcagucggcguccagcggcucugcuuguucgugugugugucguugcaggccuuauucaagcuuaccaugcacuacugcguccucuccgccuuccucauccuccaccucgucaccgucgcccucucccucuccaccugcuccacccucgacauggaccaguucaugcgcaagcgcaucgaggccauccgcggccagauccucuccaagcucaagcucaccuccccccccgaggacuaccccgagcccgaggaggucccccccgaggucaucuccaucuacaacuccacccgcgaccuccuccaggagaaggccucccgccgcgccgccgccugcgagcgcgagcgcuccgacgaggaguacuacgccaaggaggucuacaagaucgacaugccccccuucuuccccuccgagaacgccaucccccccaccuucuaccgccccuacuuccgcaucguccgcuucgacgucuccgccauggagaagaacgccuccaaccucgucaaggccgaguuccgcgucuuccgccuccagaaccccaaggcccgcguccccgagcagcgcaucgagcucuaccagauccucaaguccaaggaccucaccucccccacccagcgcuacaucgacuccaaggucgucaagacccgcgccgagggcgaguggcucuccuucgacgucaccgacgccguccacgaguggcuccaccacaaggaccgcaaccucggcuucaagaucucccuccacugccccugcugcaccuucguccccuccaacaacuacaucauccccaacaaguccgaggagcucgaggcccgcuucgccggcaucgacggcaccuccaccuacaccuccggcgaccagaagaccaucaaguccacccgcaagaagaacuccggcaagaccccccaccuccuccucaugcuccuccccuccuaccgccucgagucccagcagaccaaccgccgcaagaagcgcgcccucgacgccgccuacugcuuccgcaacguccaggacaacugcugccuccgcccccucuacaucgacuucaagcgcgaccucggcuggaaguggauccacgagcccaagggcuacaacgccaacuucugcgccggcgccugccccuaccucugguccuccgacacccagcacucccgcguccucucccucuacaacaccaucaaccccgaggccuccgccucccccugcugcgucucccaggaccucgagccccucaccauccucuacuacaucggcaagacccccaagaucgagcagcucuccaacaugaucgucaaguccugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4080 - RNA, 1586 nt, Artificial Sequence
  mRNA product Design3 comprising derived and/or modified sequence from Homo sapiens__NP_003230.1__HsTGFB3 (opt2)
gggagagucccgcagucggcguccagcggcucugcuuguucgugugugugucguugcaggccuuauucaagcuuaccaugaagaugcaccuccagcgcgcccucgucguccucgcccuccucaacuucgccaccgucucccucucccucuccaccugcaccacccucgacuucggccacaucaagaagaagcgcgucgaggccauccgcggccagauccucuccaagcuccgccucaccuccccccccgagcccaccgucaugacccacguccccuaccagguccucgcccucuacaacuccacccgcgagcuccucgaggagaugcacggcgagcgcgaggagggcugcacccaggagaacaccgaguccgaguacuacgccaaggagauccacaaguucgacaugauccagggccucgccgagcacaacgagcucgccgucugccccaagggcaucaccuccaaggucuuccgcuucaacgucuccuccgucgagaagaaccgcaccaaccucuuccgcgccgaguuccgcguccuccgcguccccaaccccuccuccaagcgcaacgagcagcgcaucgagcucuuccagauccuccgccccgacgagcacaucgccaagcagcgcuacaucggcggcaagaaccuccccacccgcggcaccgccgaguggcucuccuucgacgucaccgacaccguccgcgaguggcuccuccgccgcgaguccaaccucggccucgagaucuccauccacugccccugccacaccuuccagcccaacggcgacauccucgagaacauccacgaggucauggagaucaaguucaagggcgucgacaacgaggacgaccacggccgcggcgaccucggccgccucaagaagcagaaggaccaccacaacccccaccucauccucaugaugauccccccccaccgccucgacaaccccggccagggcggccagcgcaagaagcgcgcccucgacaccaacuacugcuuccgcaaccucgaggagaacugcugcguccgcccccucuacaucgacuuccgccaggaccucggcuggaaguggguccacgagcccaagggcuacuacgccaacuucugcuccggccccugccccuaccuccgcuccgccgacaccacccacuccaccguccucggccucuacaacacccucaaccccgaggccuccgccucccccugcugcgucccccaggaccucgagccccucaccauccucuacuacgucggccgcacccccaaggucgagcagcucuccaacauggucgucaaguccugcaagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4081 - RNA, 1733 nt, Artificial Sequence
  mRNA product Design3 comprising derived and/or modified sequence from Homo sapiens__NP_001057.1__HsTNFRSF1B (opt2)
gggagagucccgcagucggcguccagcggcucugcuuguucgugugugugucguugcaggccuuauucaagcuuaccauggcccccgucgccgucugggccgcccucgccgucggccucgagcucugggccgccgcccacgcccuccccgcccaggucgccuucacccccuacgcccccgagcccggcuccaccugccgccuccgcgaguacuacgaccagaccgcccagaugugcugcuccaagugcucccccggccagcacgccaaggucuucugcaccaagaccuccgacaccgucugcgacuccugcgaggacuccaccuacacccagcucuggaacuggguccccgagugccucuccugcggcucccgcugcuccuccgaccaggucgagacccaggccugcacccgcgagcagaaccgcaucugcaccugccgccccggcugguacugcgcccucuccaagcaggagggcugccgccucugcgccccccuccgcaagugccgccccggcuucggcgucgcccgccccggcaccgagaccuccgacgucgucugcaagcccugcgcccccggcaccuucuccaacaccaccuccuccaccgacaucugccgcccccaccagaucugcaacgucgucgccauccccggcaacgccuccauggacgccgucugcaccuccaccucccccacccgcuccauggcccccggcgccguccaccucccccagcccgucuccacccgcucccagcacacccagcccacccccgagcccuccaccgcccccuccaccuccuuccuccuccccaugggccccuccccccccgccgagggcuccaccggcgacuucgcccuccccgucggccucaucgucggcgucaccgcccucggccuccucaucaucggcgucgucaacugcgucaucaugacccaggucaagaagaagccccucugccuccagcgcgaggccaaggucccccaccuccccgccgacaaggcccgcggcacccagggccccgagcagcagcaccuccucaucaccgcccccuccuccuccuccuccucccucgaguccuccgccuccgcccucgaccgccgcgcccccacccgcaaccagccccaggcccccggcgucgaggccuccggcgccggcgaggcccgcgccuccaccggcuccuccgacuccucccccggcggccacggcacccaggucaacgucaccugcaucgucaacgucugcuccuccuccgaccacuccucccagugcuccucccaggccuccuccaccaugggcgacaccgacuccucccccuccgagucccccaaggacgagcagguccccuucuccaaggaggagugcgccuuccgcucccagcucgagacccccgagacccuccucggcuccaccgaggagaagccccucccccucggcguccccgacgccggcaugaagcccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4082 - RNA, 860 nt, Artificial Sequence
  mRNA product Design3 comprising derived and/or modified sequence from Homo sapiens__NP_002623.2__HsPGF (opt2)
gggagagucccgcagucggcguccagcggcucugcuuguucgugugugugucguugcaggccuuauucaagcuuaccaugcccgucaugcgccucuuccccugcuuccuccagcuccucgccggccucgcccuccccgccguccccccccagcagugggcccucuccgccggcaacggcuccuccgaggucgaggucguccccuuccaggaggucuggggccgcuccuacugccgcgcccucgagcgccucgucgacgucgucuccgaguaccccuccgaggucgagcacauguucucccccuccugcgucucccuccuccgcugcaccggcugcugcggcgacgagaaccuccacugcguccccgucgagaccgccaacgucaccaugcagcuccucaagauccgcuccggcgaccgccccuccuacgucgagcucaccuucucccagcacguccgcugcgagugccgcccccuccgcgagaagaugaagcccgagcgccgccgccccaagggccgcggcaagcgccgccgcgagaagcagcgccccaccgacugccaccucugcggcgacgccgucccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4083 - RNA, 1586 nt, Artificial Sequence
  mRNA product Design3 comprising derived and/or modified sequence from Homo sapiens__NP_001020537.2__HsVEGFA (opt2)
gggagagucccgcagucggcguccagcggcucugcuuguucgugugugugucguugcaggccuuauucaagcuuaccaugaccgaccgccagaccgacaccgcccccucccccuccuaccaccuccuccccggccgccgccgcaccgucgacgccgccgccucccgcggccagggccccgagcccgcccccggcggcggcgucgagggcgucggcgcccgcggcgucgcccucaagcucuucguccagcuccucggcugcucccgcuucggcggcgccgucguccgcgccggcgaggccgagcccuccggcgccgcccgcuccgccuccuccggccgcgaggagccccagcccgaggagggcgaggaggaggaggagaaggaggaggagcgcggcccccaguggcgccucggcgcccgcaagcccggcuccuggaccggcgaggccgccgucugcgccgacuccgcccccgccgcccgcgccccccaggcccucgcccgcgccuccggccgcggcggccgcgucgcccgccgcggcgccgaggaguccggccccccccacucccccucccgccgcggcuccgccucccgcgccggccccggccgcgccuccgagaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4084 - RNA, 1046 nt, Artificial Sequence
  mRNA product Design3 comprising derived and/or modified sequence from Homo sapiens__NP_001165094.1__HsVEGFA (opt2)
gggagagucccgcagucggcguccagcggcucugcuuguucgugugugugucguugcaggccuuauucaagcuuaccaugaacuuccuccucuccuggguccacuggucccucgcccuccuccucuaccuccaccacgccaaguggucccaggccgcccccauggccgagggcggcggccagaaccaccacgaggucgucaaguucauggacgucuaccagcgcuccuacugccaccccaucgagacccucgucgacaucuuccaggaguaccccgacgagaucgaguacaucuucaagcccuccugcgucccccucaugcgcugcggcggcugcugcaacgacgagggccucgagugcguccccaccgaggaguccaacaucaccaugcagaucaugcgcaucaagccccaccagggccagcacaucggcgagauguccuuccuccagcacaacaagugcgagugccgccccaagaaggaccgcgcccgccaggagaagaaguccguccgcggcaagggcaagggccagaagcgcaagcgcaagaagucccgcuacaaguccugguccgucuacgucggcgcccgcugcugccucaugcccuggucccuccccggcccccaccccugcggccccugcuccgagcgccgcaagcaccucuucguccaggacccccagaccugcaagugcuccugcaagaacaccgacucccgcugcaaggcccgccagcucgagcucaacgagcgcaccugccgcugcgacaagccccgccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4085 - RNA, 971 nt, Artificial Sequence
  mRNA product Design3 comprising derived and/or modified sequence from Homo sapiens__NP_003368.1__HsVEGFB (opt2)
gggagagucccgcagucggcguccagcggcucugcuuguucgugugugugucguugcaggccuuauucaagcuuaccauguccccccuccuccgccgccuccuccucgccgcccuccuccagcucgcccccgcccaggcccccgucucccagcccgacgcccccggccaccagcgcaaggucgucuccuggaucgacgucuacacccgcgccaccugccagccccgcgaggucgucgucccccucaccgucgagcucaugggcaccgucgccaagcagcucguccccuccugcgucaccguccagcgcugcggcggcugcugccccgacgacggccucgagugcguccccaccggccagcaccagguccgcaugcagauccucaugauccgcuaccccuccucccagcucggcgagaugucccucgaggagcacucccagugcgagugccgccccaagaagaaggacuccgccgucaagcccgaccgcgccgccaccccccaccaccgcccccagccccgcuccguccccggcugggacuccgcccccggcgcccccucccccgccgacaucacccaccccacccccgcccccggccccuccgcccacgccgcccccuccaccaccuccgcccucacccccggccccgccgccgccgccgccgacgccgccgccuccuccgucgccaagggcggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4086 - RNA, 1607 nt, Artificial Sequence
  mRNA product Design3 comprising derived and/or modified sequence from Homo sapiens__NP_005420.1__HsVEGFC (opt2)
gggagagucccgcagucggcguccagcggcucugcuuguucgugugugugucguugcaggccuuauucaagcuuaccaugcaccuccucggcuucuucuccgucgccugcucccuccucgccgccgcccuccuccccggcccccgcgaggcccccgccgccgccgccgccuucgaguccggccucgaccucuccgacgccgagcccgacgccggcgaggccaccgccuacgccuccaaggaccucgaggagcagcuccgcuccgucuccuccgucgacgagcucaugaccguccucuaccccgaguacuggaagauguacaagugccagcuccgcaagggcggcuggcagcacaaccgcgagcaggccaaccucaacucccgcaccgaggagaccaucaaguucgccgccgcccacuacaacaccgagauccucaaguccaucgacaacgaguggcgcaagacccagugcaugccccgcgaggucugcaucgacgucggcaaggaguucggcgucgccaccaacaccuucuucaagccccccugcgucuccgucuaccgcugcggcggcugcugcaacuccgagggccuccagugcaugaacaccuccaccuccuaccucuccaagacccucuucgagaucaccgucccccucucccagggccccaagcccgucaccaucuccuucgccaaccacaccuccugccgcugcauguccaagcucgacgucuaccgccagguccacuccaucauccgccgcucccuccccgccacccucccccagugccaggccgccaacaagaccugccccaccaacuacauguggaacaaccacaucugccgcugccucgcccaggaggacuucauguucuccuccgacgccggcgacgacuccaccgacggcuuccacgacaucugcggccccaacaaggagcucgacgaggagaccugccagugcgucugccgcgccggccuccgccccgccuccugcggcccccacaaggagcucgaccgcaacuccugccagugcgucugcaagaacaagcucuuccccucccagugcggcgccaaccgcgaguucgacgagaacaccugccagugcgucugcaagcgcaccugcccccgcaaccagccccucaaccccggcaagugcgccugcgagugcaccgaguccccccagaagugccuccucaagggcaagaaguuccaccaccagaccugcuccugcuaccgccgccccugcaccaaccgccagaaggccugcgagcccggcuucuccuacuccgaggaggucugccgcugcguccccuccuacuggaagcgcccccagauguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4087 - RNA, 1412 nt, Artificial Sequence
  mRNA product Design3 comprising derived and/or modified sequence from Homo sapiens__NP_004460.1__HsVEGFD (opt2)
gggagagucccgcagucggcguccagcggcucugcuuguucgugugugugucguugcaggccuuauucaagcuuaccauguaccgcgagugggucgucgucaacgucuucaugaugcucuacguccagcucguccagggcuccuccaacgagcacggccccgucaagcgcuccucccaguccacccucgagcgcuccgagcagcagauccgcgccgccuccucccucgaggagcuccuccgcaucacccacuccgaggacuggaagcucuggcgcugccgccuccgccucaaguccuucaccuccauggacucccgcuccgccucccaccgcuccacccgcuucgccgccaccuucuacgacaucgagacccucaaggucaucgacgaggaguggcagcgcacccagugcuccccccgcgagaccugcgucgaggucgccuccgagcucggcaaguccaccaacaccuucuucaagccccccugcgucaacgucuuccgcugcggcggcugcugcaacgaggagucccucaucugcaugaacaccuccaccuccuacaucuccaagcagcucuucgagaucuccgucccccucaccuccguccccgagcucguccccgucaaggucgccaaccacaccggcugcaagugccuccccaccgccccccgccaccccuacuccaucauccgccgcuccauccagauccccgaggaggaccgcugcucccacuccaagaagcucugccccaucgacaugcucugggacuccaacaagugcaagugcguccuccaggaggagaacccccucgccggcaccgaggaccacucccaccuccaggagcccgcccucugcggcccccacaugauguucgacgaggaccgcugcgagugcgucugcaagacccccugccccaaggaccucauccagcaccccaagaacugcuccugcuucgagugcaaggagucccucgagaccugcugccagaagcacaagcucuuccaccccgacaccugcuccugcgaggaccgcugccccuuccacacccgccccugcgccuccggcaagaccgccugcgccaagcacugccgcuuccccaaggagaagcgcgccgcccagggcccccacucccgcaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4088 - RNA, 977 nt, Artificial Sequence
  mRNA product Design3 comprising derived and/or modified sequence from Homo sapiens__NP_061986.1__HsFGF21 (opt3)
gggagagucccgcagucggcguccagcggcucugcuuguucgugugugugucguugcaggccuuauucaagcuuaccauggacagcgaugagaccggcuucgaacacuccgggcugugggugucuguccucgccggacuucuguugggugcuugccaggcacaucccaucccugacucaaguccauuacugcaauuuggcgggcagguuagacagagguaccuauauacagaugacgcccagcaaacugaggcgcaccucgaaauucgggaggauggaacggugggcggugcugccgaccagagcccggaaucccugcuucagcugaaggcauugaaacccgggguaauacagauccucggagugaagaccucucgcuuccugugucaacgaccugauggcgcccuguacggcucgcuccauuuugacccagaggcuugcucauuccgugaguuacugcuugaagauggguauaacgucuaccagagcgaggcacacggauugccccugcaucuaccugguaauaaaaguccacacagagaccccgccccuaggggcccagcucgguuucucccgcugcccgggcuuccuccagcccugcccgaaccuccaggaauuuuggcgccccagccgccugaugugggcuccucugacccccucagcaugguugguccaucccaggggcgcucaccuaguuaugcaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4089 - RNA, 1757 nt, Artificial Sequence
  mRNA product Design3 comprising derived and/or modified sequence from Homo sapiens__NP_002412.1__HsMMP1 (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4090 - RNA, 1517 nt, Artificial Sequence
  mRNA product Design3 comprising derived and/or modified sequence from Homo sapiens__NP_002412.1__HsMMP1(1-19,100-469) (opt3)
gggagagucccgcagucggcguccagcggcucugcuuguucgugugugugucguugcaggccuuauucaagcuuaccaugcacagcuuucccccucugcuccuucuguuguucuggggcguggucucccauucuuucguuuuaaccgaggggaacccaagaugggaacagacacaccugacuuacaggaucgagaauuauacgccggaccuaccccgggccgauguggaccaugcuauugaaaaggcauuucaacucuggucaaacguaaccccucugacauucacuaaagugagugagggacaggccgauauaaugaucagcuuuguccgcggugaccaccgagauaauuccccauucgacggccccgggggaaaccuugcgcaugcuuuucagccuggcccagguauugggggagaugcccacuucgacgaagaugagcguuggaccaauaacuuuagagaguacaaucugcacaggguggcagcccaugaauugggccacucucucggccugucgcauucaacagacaucggggcucugauguaucccagcuacaccuucaguggagauguucagcucgcacaagacgauauugacgguauccaggccauauauggccggucccagaacccugugcagccaaucgggccgcaaacucccaaggcuugcgacucuaaauuaacauuugaugccauuaccacgauccgcggagaggucauguucuuuaaggacagauucuacaugaggacuaauccuuucuauccagaaguggagcugaacuuuauuagcguauucuggccccagcuuccuaauggcuuggaggcggcauacgaauuugccgaucgggacgagguucgcuucuuuaaagguaacaaguacugggcugugcaggggcagaauguccugcacggauauccaaaggauaucuacuccucauucggcuuuccccgaaccgugaaacacauagacgccgcacuaagugaagagaacacaggcaagacuuauuucuuuguggcuaauaaauacuggagauaugaugaauacaagaggagcauggacccgggguauccuaaaaugauugcccaugauuuccccggaaucggucacaaggucgacgcgguuuuuaugaaggauggcuucuuuuacuucuuccaugggacccggcaauacaaauuugacccaaagacaaaacguauucucacccugcagaaggccaacucuugguucaacugucgcaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4091 - RNA, 3704 nt, Artificial Sequence
  mRNA product Design3 comprising derived and/or modified sequence from Clostridium histolyticum__BAA77453.1__ColG (opt3)
gggagagucccgcagucggcguccagcggcucugcuuguucgugugugugucguugcaggccuuauucaagcuuaccaugaagaaaaacauccugaagauucucauggacagcuacuccaaagagucuaagauacagaccgugagaagggucacaucaguuagucuucuggccguguauuugacuaugaauacgagcuccuuaguacuggcuaaacccaucgaaaacaccaaugauacaucuauuaagaacguggagaagcuacggaaugcaccuaacgaagaaaauucgaaaaaggucgaagacucaaagaacgauaagguggagcacguuaaaaauaucgaggaagccaagguggagcaagucgcgccagaaguaaagagcaaaaguacucuccgcuccgcuucuauugccaacaccaauagcgagaaguacgacuucgaguaucugaacggccuuuccuacacagaacugaccaauuugaucaaaaacauaaaguggaaucagaucaacgggcucuuuaacuauucaacuggaagucagaaauucuuuggugauaagaaucgagugcaggcaauuaucaacgcccugcaagagagcggccguacauacaccgcuaaugacaugaaagggauugaaacguucacugagguucugagagcaggauuuuaucucggcuacuacaacgaugguuuaucuuaucugaaugacaggaacuuccaggauaagugcaucccggccaugauagcuauucagaagaaucccaacuuuaaacuugggaccgccgugcaggacgaagucaucacauccuugggaaagcugauuggcaaugcgucagcaaacgccgagguggugaauaacugugucccuguucuaaaacaauuccgggagaaucucaaccaguacgcuccagauuaugugaagggcacugccguaaaugaacugaucaaagggaucgaguuugacuucagcggagcagcuuacgaaaaggaugugaagaccaugcccugguaugguaaaauugacccuuuuauaaacgagcuuaaggcccugggcuuguacgggaacaucacaagugcgaccgaaugggccucugacgucggaauuuauuaccucuccaaauucggccuguacagcacgaaucgcaacgauaucgugcagucguuagagaaggcaguugacauguauaaauacgguaagauagcuuuuguggccauggagagaauuacuugggauuaugacgggaucggaucuaauggcaagaaagucgaucaugacaaguuccuggaugacgcugaaaaacacuaccucccaaagacauauaccuucgauaacggcacuuuuaucauuagggccggggacaaaguguccgaggaaaagaucaagcggcuuuacugggcaucacgcgagguaaaaagucaguuccaucgaguugugggaaaugauaaggcccuggaagucgguaacgcugacgacguguugacaaugaaaauuuuuaauagccccgaggaguauaaguucaacaccaauauaaacggcgucuccacggauaaugggggacuauacaucgaaccuagaggcaccuuuuacacauaugagaggacuccacaacagucuauuuucagccuggaggagcucuuucggcacgaguacacccauuaucugcaggcgcguuaccuuguggacggucugugggggcaaggcccguucuaugaaaagaaccgcuugacaugguuugaugagggaacugcagaguucuuugccggcucaaccagaacaagugggguucuccccaggaaguccauccugggauacuuagcuaaagacaagguggaucaccgguauagccugaagaaaacccuaaauucugguuacgacgauucagacuggauguucuacaacuauggcuuugccguagcacacuaccucuaugaaaaggauaugccuacuuucaucaaaaugaauaaggccauucugaacacggacgucaaaaguuacgaugaaauaaucaagaaacuuagcgacgaugcuaacaaaaauacagaguaucagaaccauauucaggaguuggccgacaaguaccagggggcaggaaucccacugguguccgacgauuaucucaaagaccacggcuacaagaaagcgucugaaguuuacucggagauuagcaaggcugccucccugaccaauacuucagugaccgcagaaaagagucaauauuucaacacauuuacccuucgagguacuuacacaggggagacgucuaaaggcgaguucaaggauugggacgaaaugagcaaaaagcuggauggaaccuuggagucccucgccaaaaauucauggagcggcuauaagacucugacagcuuacuuuaccaacuaucgcgucacaucugacaauaaggugcaguacgauguaguguuccaugggguuuuaacugacaacgccgauaucuccaauaacaaagcacccauagcuaaggucaccggaccuaguacgggugccgugggcagaaauaucgaauuuagcgggaaagacucuaaggaugaggacggaaaaauuguguccuaugauugggacuucggcgacggugcgaccucaagggggaagaacaguguccacgccuacaaaaaggcuggcacauacaauguuacucugaaggugaccgaugacaaaggagcaacagccacugagagcuuuaccaucgaaauuaagaacgaagauacgacaaccccaaucacuaaagagauggagcccaaugacgauauaaaggaagcuaacggcccgauuguggaggggguaacagucaaaggagaccuaaacggcucggaugacgccgauaccuucuauuuugacgugaaggaagauggugacguuacuaucgagcucccuuacuccgggucuagcaauuucaccuggcugguguauaaggagggagacgaucagaaccacauugcaucaggcaucgacaaaaauaacaguaaggucgguacauuuaaauccacgaagggccggcauuacguguucauauauaaacacgauucugcgagcaauaucuccuacucacuuaacauuaagggguugggaaaugaaaagcugaaagagaaggaaaacaaugacagcagugauaaagccaccguuauccccaacuuuaauacuacaaugcagggcucucuccugggggacgauucccgcgacuauuacagcuucgaggugaaggaagagggagagguaaacauugaauuagauaaaaaggacgaguucggcgucaccuggacacugcauccagaaucgaauaucaacgauagaauaacuuacggucaaguggacgggaauaaggugucaaacaaagucaaacuuaggccuggaaaauauuacuugcucguuuauaaguacucuggcagugguaauuaugagcugcgugugaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4092 - RNA, 3428 nt, Artificial Sequence
  mRNA product Design3 comprising derived and/or modified sequence from Clostridium histolyticum__BAA77453.1__HsALB(1-18)_ColG(111-1118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaauugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4093 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4094 - RNA, 3452 nt, Artificial Sequence
  mRNA product Design3 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaacuuccugaagaucauucucaauagaggcaaaaccaugaagaggaaaugccuuagcaagcggcugauguuggccauaacaauggcuacuaucuuuacggugaacuccaccuuacccauuuacgcagccgucgacaaaaauaacgcgacagcugccguucagaaugagucuaagcgcuauacugugucauaccugaagacccuaaacuauuacgaucucguagaccugcuugugaaaacagaaaucgagaaucugccugauuuguuccaauauaguagcgacgcaaaggaauuuuacgggaacaaaacccgaauguccuucauuauggaugagaucggacguagagccccacaguauacugaaauagaccacaaggguaucccgacacucgucgaggugguuagggcuggcuuuuaccugggguuccauaauaaagagcugaacgaaauuaauaagcggucuuuuaaggagcgcgugauccccucgauucucgcaauccagaaaaacccuaauuucaaguuaggaaccgaaguccaggauaaaauagugucagccacgggccugcuugcugguaacgagacugccccacccgagguaguuaauaacuuuaccccuauuuugcaagacuguaucaagaacauugauagauacgcgcuggacgaucuaaaaagcaaggcacucuucaaugugcuggccgcuccaacauaugacaucacugaauaccuuagggccaccaaagagaagcccgaaaacacaccuugguaugggaagaucgauggauuuauuaaugagcugaaaaaguuggcacucuacggcaaaauaaacgacaauaacaguuggaucauugacaauggcaucuaucacauagcuccacuggggaaguuacauuccaacaauaaaauuggaaucgaaacccugacggaggucaugaagguguacccguaucucucuaugcagcaccuucagagcgccgaucagaucaagcggcauuacgacuccaaagaugcggaggguaacaagauuccccuggacaaauucaagaaagaaggcaaggagaaguacugcccuaaaacuuauacauuugaugacgggaaggugaucauuaaagccggagcacgcgucgaagaggaaaagguuaaacgauuguacugggcuucaaaggaggugaauagucaauucuucagaguauauggcauagauaagccacuagaggaagguaaccccgacgauauccugaccauggugauuuacaauagcccugaggaauauaaacucaacucuguccuguacggguaugacacuaauaacggaggcauguacaucgagccagaaggcacauuuuucaccuacgagagggaggcccaggaauccacguauacccuugaggaacuguuucggcacgaguacacacacuauuugcaggggcguuacgcugugcccggacaguggggucgcacuaagcucuaugauaacgacagacugaccugguacgaggaaggcggggccgaguuauucgcaggaucaacaaggacuagcggcauccugccgcggaaaaguauuguuucuaauauacauaacaccacacgaaauaaccgcuauaagcuauccgacaccgugcacagcaaauacggugccucguuugaguucuacaauuaugcuuguauguuuauggauuacauguauaacaaggacauggggauccucaauaaacugaacgaucuugcgaagaauaacgacgucgauggcuacgacaauuauauuagagauuugucuuccaacuacgcacugaaugacaaguaucaagaucauaugcaggaaaggaucgacaacuacgaaaaucucacugugccuuucguagccgaugacuaccugguucggcacgcuuauaaaaaccccaacgagauuuacucagagaucagugaaguggccaaacuuaaggaugcaaagagcgaggucaaaaagucccaguauuuuucuacguucacacugcgcggaagcuacaccggcggggccucaaagggaaaauuggaagaccaaaaggcuaugaauaaauuuauagacgauagucucaagaaacuggacacuuauuccuggagcgguuacaagaccuuaacagccuauuucaccaacuacaagguggauucuucaaauagagucacuuacgacgugguuuuucacggcuaucugccaaacgagggggauaguaaaaauagccuaccuuacggaaagaucaacggcacauauaaagguacggaaaaggagaaaauuaaguucuccucugaggggucguucgaccccgauggcaagaucgugagcuacgaaugggacuuuggagauggcaauaaauccaacgaggaaaauccagagcauucauaugacaagguagggaccuacacugucaaacucaaggugacagaugacaaaggagaaaguucuguuagcaccacaacugcagagauuaaggaucuguccgagaacaaacuucccgugaucuauaugcacgucccuaagucaggugcguugaaucagaaggugguauucuacggcaaagggaccuacgacccagacggaagcauagcuggcuaucagugggauuuuggugacgggucugauuucuccagugaacagaacccgagccauguguacacgaagaaaggcgaguauaccguuacacugagggucauggacucuuccggacaaaugucagaaaagacuaugaaaauuaagaucaccgaucccguguacccuauuggcacagagaaggagccaaauaacaguaaagaaacugccagcgggcccaucgugccuggaauaccagucucgggcaccaucgagaauacguccgaccaggauuauuuuuacuucgacguuauuacacccggugaagugaagaucgauauuaacaaacucggguauggaggcgcaaccugggugguauacgacgagaacaauaacgccgucucuuacgcuacugaugacggucagaaucugagcggcaaguuuaaagccgacaagccggggcguuauuacauccacuuauauauguucaacggaucauacaugccuuaucggauaaauauugaaggcaguguggggcgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4095 - RNA, 3413 nt, Artificial Sequence
  mRNA product Design3 comprising derived and/or modified sequence from Clostridium histolyticum__BAA34542.1__ColH (opt3)
gggagagucccgcagucggcguccagcggcucugcuuguucgugugugugucguugcaggccuuauucaagcuuaccaugaagagaaaaugccugagcaagaggcucaugcuugccaucaccauggcuacaauuuucacugugaacuccacgcugcccauauacgcagccgucgacaaaaauaacgcgaccgcugccguucagaaugagucuaagcgguauacagugucauacuugaaaacuuuaaacuauuacgaucugguagaccuacucgugaagaccgaaaucgagaaucugccugaucuuuuucaauauaguagcgacgcaaaggaguucuacggcaacaaaacacgcauguccuuuauuauggaugaaaucgggcgacgugccccacaguauaccgaaauugaccacaagggaaucccgacucuggucgaggugguuagagcugguuucuacuugggcuuucauaauaaagagcucaacgaaauaaauaagaggucuuucaaagagcgggugauccccucgauucuggcaauccagaagaacccuaauuuuaagcuggggacagaaguccaggauaaaauugugucagccaccggacucuuagcuggcaacgagacggccccacccgagguaguuaauaacuucacuccuauccugcaagacuguauaaagaauauugaucgcuacgcgcuugacgauuugaaaagcaaggcacuguuuaacgugcuagccgcuccaaccuaugacaucacagaauaccucagagccacuaaagagaagcccgaaaacaccccuugguaugguaaaauugauggguucaucaaugagcugaagaagcuggcacuguacggaaaaaucaacgacaauaacaguuggauuauagacaauggcaucuaucacauugcuccauugggcaagcuccauuccaacaauaaaaucgggauagaaacacugaccgaggucaugaagguguacccguauuuaucuaugcagcaccuucagagcgccgaucagauuaaaaggcauuacgacuccaaggaugcggagggaaacaagaucccccucgacaaauuuaagaaagaagguaaggagaaauacugcccuaagacguauacuuucgaugacggcaaggugaucauuaaagccggggcacgggucgaagaggaaaagguuaaacgccuuuacugggcuucaaaggaggugaauagucaauuuuuccgaguauauggaaucgauaaaccacuggaggaaggcaaccccgacgauauuuugacaauggugauauacaauagcccugaggaauauaagcuaaacucuguccuguacgguuaugacaccaauaacgggggaauguacaucgagccagaaggcacuuucuuuacauacgagagagaggcccaggaauccaccuauacgcucgaggaacuguucaggcacgaguacacccacuaucuucagggccgguacgcugugcccgggcaguggggacguacaaagcuguaugauaaugaccgcuugacuugguacgaggaagguggcgccgagcucuuugcagggucaaccagaacaagcggcauucugccgaggaaaaguaucguuucuaacauccauaacacuacccggaauaaccgauauaaguuauccgacacagugcacagcaaauacggagccucguucgaauuuuacaauuaugcuuguauguucauggauuacauguauaacaaggacauggguauucugaauaaacuaaacgaucucgcgaagaauaacgacgucgauggguacgacaauuauauacgcgaucugucuuccaacuacgcacuuaaugacaaauaucaagaucauaugcaggagagaaucgacaacuacgaaaauuugaccgugccuuuuguagccgaugacuaccugguuaggcacgcuuauaagaaccccaaugagauuuacucagagaucagugaaguggccaagcucaaagaugcaaagagcgaggucaaaaagucccaguauuucucuacuuuuacgcugcggggcagcuacacaggaggcgccucaaaagggaaacuugaagaccaaaaggcuaugaacaaguucauugacgauagucugaagaaauuggacaccuauuccuggagcggauacaagacucucaccgccuauuuuacaaacuacaaaguggauucuucaaaucgcgucaccuacgacgugguuuuccacgguuaucugccaaacgagggcgauaguaagaauagcuuaccuuacgggaagaucaacggaacuuauaaaggcacagaaaaggagaaaauaaaguuuuccucugaggguucguucgaccccgaugggaaaaucgugagcuacgaaugggacuucggcgauggaaauaaguccaacgaggaaaauccagagcauucauaugacaagguaggcacguacaccgucaaacugaaggugacugaugacaaaggggaaaguucuguuagcacaaccacagcagagauuaaggaucuauccgagaacaaacuccccgugaucuauaugcacgucccuaagucaggagcgcugaaucagaaagugguauuuuacgguaagggcacuuacgacccagacgggagcauugcuggauaucagugggauuucggcgacgguucugauuuuuccagugaacagaacccgagccauguguacaccaagaaaggggaguauacgguuacccuuagagucauggacucuuccggccaaaugucagaaaagacaaugaaaaucaagauaacugaucccguguacccuauuggaaccgagaaagagccaaauaacaguaaggaaacagccagcggccccaucgugccugggauuccagucucgggaacuaucgagaauaccuccgaccaggauuauuucuacuuugacguuauaacgcccggcgaagugaagaucgauauuaacaaauuggguuaugggggagcaacaugggugguauacgacgagaauaacaacgccgucucuuacgcuaccgaugacggccagaaucugagcgguaaguucaaagccgacaagccgggcagguauuacauccaccucuauauguuuaacgggucauacaugccuuaucguauuaauaucgaaggaagugugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4096 - RNA, 3347 nt, Artificial Sequence
  mRNA product Design3 comprising derived and/or modified sequence from Clostridium histolyticum__BAA34542.1__HsALB(1-18)_ColH(41-1021) (opt3)
gggagagucccgcagucggcguccagcggcucugcuuguucgugugugugucguugcaggccuuauucaagcuuaccaugaagugggugaccuucaucagccugcucuuucuuuucuccucugccuacucaguccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4097 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt3)
gggagagucccgcagucggcguccagcggcucugcuuguucgugugugugucguugcaggccuuauucaagcuuaccaugaagugggugaccuucaucagccugcucuuucuuuucuccucugccuacucaaugaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4098 - RNA, 923 nt, Artificial Sequence
  mRNA product Design3 comprising derived and/or modified sequence from Homo sapiens__NP_001133.1__HsAMELX (opt3)
gggagagucccgcagucggcguccagcggcucugcuuguucgugugugugucguugcaggccuuauucaagcuuaccaugggcaccuggauccuguucgccugccuccuuggggcugcauuugccaugccccugccuccacacccgggacaucccgguuacauuaacuucagcuaugagguguugacaccuuuaaagugguaccaguccauaagaccacccuauccuucuuacggcuaugaaccaaugggaggguggcugcaccaucaaaucauucccguccuaucacagcagcacccuccaacucauacgcuccagccgcaccaccauauccccguugugccugcgcaacagccaguaauuccccagcagccuaugaugccagugcccggccaacacaguaugaccccgauccagcaucaccagccuaaucugcccccuccagcucagcaacccuaccagccacagcccguccaaccucagccacaccagccgaugcagccccaaccuccagugcaucccaugcagccucuuccaccccagccgccucugccacccauguuuccuaugcagcccuugccaccuaugcuccccgaccugacacuggaggccuggccaagcacugauaaaaccaagagggaagagguugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4099 - RNA, 482 nt, Artificial Sequence
  mRNA product Design3 comprising derived and/or modified sequence from Homo sapiens__NP_001133.1__HsAMELX-TRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccauuagaccacccuauccuucuuacggauaugaaccaauggguggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4100 - RNA, 515 nt, Artificial Sequence
  mRNA product Design3 comprising derived and/or modified sequence from Homo sapiens__NP_001133.1__HsAMELX-LRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccauuagaccacccccuaugcugccagacuugacauuagaagccuggcccucuacugauaaaacgaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4101 - RNA, 554 nt, Artificial Sequence
  mRNA product Design3 comprising derived and/or modified sequence from Homo sapiens__NP_001133.1__HLA-A2-SP_HsAMELX(17-60) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuuauccaucauacgguuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4102 - RNA, 587 nt, Artificial Sequence
  mRNA product Design3 comprising derived and/or modified sequence from Homo sapiens__NP_001133.1__HLA-A2-SP_HsAMELX(17-47,168-191) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuauuaggcccccuccaaugcugcccgaccuuacccuggaggcuuggccuucaacagauaaaacuaagcgggaagaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4103 - RNA, 926 nt, Artificial Sequence
  mRNA product Design3 comprising derived and/or modified sequence from Homo sapiens__NP_001134.1__HsAMELY (opt3)
gggagagucccgcagucggcguccagcggcucugcuuguucgugugugugucguugcaggccuuauucaagcuuaccaugggcaccuggauccuguucgccugccucgugggggcugcauuugccaugccccuuccuccacacccgggacaucccgguuacauuaacuucagcuaugagguccugacaccuuugaagugguaccaguccaugauaagaccacccuauucuucauacggcuaugaaccuaugggagggugguuacaccaucaaaucauuccaguugugagucagcagcacccccugacucauacgcuacagagccaccaccauaucccuguagugccagcgcaacagccgaggguccggcagcaggcucucaugcccgugccuggccaacaguccaugaccccaacacagcaccaucagcccaaucugccucuuccagcccaacagcccuuucagccgcaaccuguucagccccagccacaccagccuaugcaaccccagccacccgugcagccuaugcagccacuguugccgcaacccccucucccacccauguucccucugcgcccacugcccccgauucucccugacuuacaccuggaggcauggccagccacugauaaaaccaagcaggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4104 - RNA, 485 nt, Artificial Sequence
  mRNA product Design3 comprising derived and/or modified sequence from Homo sapiens__NP_001134.1__HsAMELY-TRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccaugauuagaccacccuauucuucauacggauaugaaccuauggguggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4105 - RNA, 518 nt, Artificial Sequence
  mRNA product Design3 comprising derived and/or modified sequence from Homo sapiens__NP_001134.1__HsAMELY-LRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccaguccaugauuagaccacccccuauacugccagacuugcacuuagaagccuggcccgcuacagauaaaacuaagcaagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4106 - RNA, 557 nt, Artificial Sequence
  mRNA product Design3 comprising derived and/or modified sequence from Homo sapiens__NP_001134.1__HLA-A2-SP_HsAMELY(17-61) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuuauucaaguuacgguuaugaaccaaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4107 - RNA, 590 nt, Artificial Sequence
  mRNA product Design3 comprising derived and/or modified sequence from Homo sapiens__NP_001134.1__HLA-A2-SP_HsAMELY(17-48,169-192) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaucuaugauuaggcccccuccaauacugcccgaccuucaccuggaggcuuggccugccaccgauaaaacaaagcaggaagaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4108 - RNA, 917 nt, Artificial Sequence
  mRNA product Design3 comprising derived and/or modified sequence from Sus scrofa__NP_999071.1__SsAMELX-001-1 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4109 - RNA, 485 nt, Artificial Sequence
  mRNA product Design3 comprising derived and/or modified sequence from Sus scrofa__NP_999071.1__SsAMELX-TRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccagaauaugauuagacacccauauacauccuacggauaugaacccauggguggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4110 - RNA, 518 nt, Artificial Sequence
  mRNA product Design3 comprising derived and/or modified sequence from Sus scrofa__NP_999071.1__SsAMELX-LRAP (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccagaauaugauuagacacccaucccuguugcccgacuuaccucuggaagccuggccagcuacagauaaaacuaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4111 - RNA, 557 nt, Artificial Sequence
  mRNA product Design3 comprising derived and/or modified sequence from Sus scrofa__NP_999071.1__HLA-A2-SP_SsAMEL(17-61) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccuauaccucuuacgguuaugaaccuaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4112 - RNA, 590 nt, Artificial Sequence
  mRNA product Design3 comprising derived and/or modified sequence from Sus scrofa__NP_999071.1__HLA-A2-SP_SsAMEL(17-49,167-189) (opt3)
gggagagucccgcagucggcguccagcggcucugcuuguucgugugugugucguugcaggccuuauucaagcuuaccauggccgugauggcucccagaacccugguccuccuucugagcggcgcauuggccuuaacacagacuugggcgaugccucugccaccgcaccccgggcauccuggauacaucaacuucuccuaugagguucuaacgccacucaagugguaccaaaauaugauuaggcaccccucucugcuuccugaccugccauuggaggcuuggcccgccaccgauaaaacaaagcgggaagaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4113 - RNA, 881 nt, Artificial Sequence
  mRNA product Design3 comprising derived and/or modified sequence from Sus scrofa__P45561-2__SsAMELX-001-2 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuauauaagacacccuuacacaucuuauggcuacgagccaaugggagggugguugcaucaccagaucauucccguggucucacaacagacuccucagagucaugccuuacagccacaccaccauauccccaugguuccugcgcaacagccaggcauuccgcagcagcccaugaugccucugccaggucaacacagcaugacgcccacccagcaucaccagccuaaucuaccacuccccgcucagcaaccguuucagccucagcccgugcaaccacagccucaccagccccugcagccacaaucccccaugcauccuauccagccacuucugccgcagcccccuuugccacccauguucucuaugcagucgcuccugccugaccugccacucgaagccuggcccgcaacagauaagacuaaaagggaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4114 - RNA, 917 nt, Artificial Sequence
  mRNA product Design3 comprising derived and/or modified sequence from Sus scrofa__NP_998965.1__SsAMELX-001-3 (opt3)
gggagagucccgcagucggcguccagcggcucugcuuguucgugugugugucguugcaggccuuauucaagcuuaccaugggcaccuggaucuucuuugccugccugcucggggcuagccuugcaaugccccugccuccacacccgggacaucccgguuacauuaacuucuccuaugagguguugacaccuuuaaagugguaccagaauaugauaagacacccauauacuucuuacggcuaugaacccaugggaggguggcugcaucaccaaaucauuccugucguuucacagcagacgccacagagucaugcccuacaaccccaccaccauaucccuauggugccagcgcagcagccgggcauuccccagcaaccuaugaugccacuccccggucagcacagcaugaccccuacacagcaucaccagccaaaccugccccuuccggcucaacagccuuuucagccccaaccaguacagccucagccccaccagccacugcaaccccaguccccuaugcauccaauccagccguugcucccccagccuccacugcccccuauguucucuaugcaaucgcugcucccagacuuaccccuggaggccuggccggcaacugauaaaaccaagagggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4115 - RNA, 566 nt, Artificial Sequence
  mRNA product Design3 comprising derived and/or modified sequence from Sus scrofa__K7GPB2__SsAMELX-002 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaucucugcuacccgaccucccucuggaagccuggccagcgacugauaaaacgaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4116 - RNA, 959 nt, Artificial Sequence
  mRNA product Design3 comprising derived and/or modified sequence from Sus scrofa__K7GLD0__SsAMELX-003 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugaggacuuguacuuagaagccauaagaaucgauaggacagcguuugugcugacuccucuaaagugguaucagaauaugauucggcacccauacacgucuuauggcuacgagcccaugggaggguggcuccaucaccaaaucauuccugucguuucacagcagaccccacagagucaugcucugcaaccccaccaccauaucccuauggugccagcccagcagccgggcauaccccagcaaccuaugaugccacuucccggucagcacagcaugacaccuacucagcaucaccagccaaaccugcccuugccggcacaacagccuuuccagccccaaccaguacagccucagccccaccagccacuccaaccccaguccccuaugcauccaauccagccgcugcugccccagccuccauuacccccuauguuuucuaugcaaucgcuccugccagaccuucccuuggaagccuggccggcuaccgauaaaacaaagcgcgaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4117 - RNA, 845 nt, Artificial Sequence
  mRNA product Design3 comprising derived and/or modified sequence from Sus scrofa__K7GPE9__SsAMELX-004 (opt3)
gggagagucccgcagucggcguccagcggcucugcuuguucgugugugugucguugcaggccuuauucaagcuuaccaugggcaccuggauccuguucgccugccuccuuggggcugcauuuagcaugccccugccuccacacccgggacaucccgguuacauuaacuucuccuaugagguguugacaccuuuaaagugguaccagaauaugauaagacacccaacuccccaaucucaugcccugcagccucaccaucacaucccaaugguccccgcgcagcagccuggcauuccacaacagccgaugaugccccuaccugggcagcacucaaugacgccaacccagcaucaccaacccaaccucccucugccagcucagcagcccuuucagccgcaaccuguucagccccagccacaucaaccucuucagccccagaguccaaugcaccccauccagccucuguugccacaaccgccccucccuccaauguucagcaugcagucccugcugcccgaccucccuuuagaagccuggccagcaacagauaaaacuaagagggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4118 - RNA, 869 nt, Artificial Sequence
  mRNA product Design3 comprising derived and/or modified sequence from Sus scrofa__J9JIM4__SsAMELX-201 (opt3)
gggagagucccgcagucggcguccagcggcucugcuuguucgugugugugucguugcaggccuuauucaagcuuaccaugccccugccuccacacccgggccaucccggguacaucaacuucagcuaugaggugcucaccccucuuaagugguaccagaauaugauuagacacccauauacauccuacggauaugaacccauggguggcuggcugcaucaccaaauaaucccugucguuucucagcagacuccacagucacaugccuugcaaccccaccaccauauuccuauggugccagcucagcagccggggaucccccagcaaccuaugaugccauuacccggacagcacaguaugacgccuacccagcaucaccagccaaaccugccccuaccggcacaacagccuuuucagccccaaccaguacagccucagccccaccagccacuccaaccccagagcccuaugcauccaauucagccgcugcuuccccagccuccacugcccccuauguucuccaugcaaucuuugcucccagaccugccccuggaggccuggccggcgacagauaaaacuaagagggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4119 - RNA, 3308 nt, Artificial Sequence
  mRNA product Design3 comprising derived and/or modified sequence from Homo sapiens__NP_006120.1__HsBMP1 (opt3)
gggagagucccgcagucggcguccagcggcucugcuuguucgugugugugucguugcaggccuuauucaagcuuaccaugcccggcguggccagacugccucuccuucugggguuguuacugcuaccaaggccgggacggccccucgaccuggcugauuacaccuaugaccuugcagaggaagaugacagcgagccucugaacuacaaggauccaugcaaagccgcggcuuucuugggugacaucgcccucgaugaagaggaccugcgcgcauuucagguccaacaggccguugaucugcgacgucacacagcuagaaaguccucuauuaaagcagccgugcccggcaauacuucaacgccuaguugucagagcaccaacgggcagccacaaaggggagcuugcggccgguggcgcgguagauccaggucucggcgcgccgcgacaucgcgacccgaaagaguauggccugacggggugauaccauucgucaucggaggcaauuuuacuggcucacagagggcaguguuccggcaggccaugcgucauugggagaagcacaccuguguuacauuucucgagcgcaccgaugaagacagcuauauuguguucacuuacagaccgugcggguguugcaguuaugucggaaggcgggguggcgggccccaggcuaucuccauuggaaagaacugugauaaguuuggcaucgugguacaugaguuaggucacguugugggguucuggcaugaacacacacgaccugaccgcgacagacacgucucuauagugagggagaauauccaaccaggacaggaguacaacuuucugaagauggaaccccaggagguggaaagccuuggcgagaccuaugauuucgacuccauuaugcauuacgcccggaauacguuuucacgcggcaucuucuuggauacuauugucccuaaauacgaaguuaacggggugaagccacccaucggacagagaaccaggcugaguaaaggugacauagcacaagcucguaagcuauauaaaugcccggccuguggcgagacacuccaggauagcacugggaauuuuucuuccccugaguaccccaacggauauucagcgcacaugcauugcguauggcggauuagcgugaccccaggcgaaaagaucauucugaauuucacaagucuugaccuguaccgaucuagauuguguugguaugauuacgucgaggugagggacgguuucuggcgcaaggccccucuccgggggagauuuugcggcuccaaacugcccgaaccaaucguuagcaccgauucgagguuauggguggaguuccgaucuuccucaaacugggucggaaagggcuuuuucgcaguguaugaagcuaucugcgggggagacguuaaaaaggauuacggucacauucagagucccaauuacccugacgacuaucgcccaagcaaaguauguauauggcggauccaaguguccgagggcuuucacgucgggcugacguuccagucuuuugagauugaacgucaugauagcugcgccuacgacuaucucgaggugagagauggacacucagaaaguuccacucuuaucggcagguacugugguuaugagaagccggacgauauaaaaagcacaucuucacgccugugguugaaguucgucagugacgggagcauuaacaaggcuggcuuugccgugaauuucuuuaaagaaguugaugagugcucccggcccaacagaggaggcugugagcagaggugccuaaacacccuggggucuuacaaguguucgugcgacccuggauaugaacucgcaccagauaaacgacgcugugaggccgcuugcgguggcuuccugacuaaacuuaaugggagcaucacaucccccggauggccuaaagaauacccacccaacaagaauuguaucuggcagcugguggcgccgacccaauaccggauuucauugcaguuugacuucuucgagacggagggcaacgauguaugcaaguaugacuuugucgaagugagaaguggucucaccgcagauucuaaacugcaugggaaguucugcggcagcgagaaaccugaaguuaucacaucccaguacaauaacaugaggguggaguuuaagucagacaauacugucagcaaaaagggauucaaggcccacuuuuucucugacaaagaugaauguuccaaggacaacggcgggugccagcaagauugugugaauaccuuuggaaguuaugagugccagugucguagcggcuucguauuacaugacaacaaacacgauugcaaggaggcugguugugaccacaaagugacaucuacuuccgggaccauuacaucaccaaauuggcccgauaaguacccuaguaagaaagaaugcaccugggccauaagcucgacucccggacaucgcguuaagcugacguuuauggagauggacaucgaaucccagccagagugugcauaugaucaccuagaagucuucgacggccgggaugccaaagcuccugugcucgguagauuuugcggcucuaagaaacccgagccagugcuggccacagggagcaggauguuccuucgauuuuacucagacaacaguguccagcggaagggauuccaagcaucccaugcgaccgaguguggcgggcagguucgcgcugaugugaaaacuaaggacuuguauucucacgcccaguucggagacaauaacuacccgggcgguguggauugcgaauggguaauugucgcagaggaaggguacggaguggagcugguuuuucagaccuucgaaguggaggaggaaacagacugcggcuaugauuacauggagcucuuugacgguuaugauagcaccgccccuagacugggcagguacuguggguccggacccccagaagaggucuauucagcuggcgacagcgugcuuguuaaguuccacagugaugacacuaucacgaaaaagggguuucaucugcgguacacaucuaccaaauuccaagauacuuugcacucccgaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4120 - RNA, 1538 nt, Artificial Sequence
  mRNA product Design3 comprising derived and/or modified sequence from Homo sapiens__NP_001191.1__HsBMP2 (opt3)
gggagagucccgcagucggcguccagcggcucugcuuguucgugugugugucguugcaggccuuauucaagcuuaccaugguggccggcaccagaugccugcucgcuuugcuguugccccaggucuuacugggaggggcagccggucuaguuccugagcucggcaggcggaaguucgcggcugccagcuccgggcgcccaucuucacaaccgagugacgaagugcugagcgaguuugaacuucgacuguuguccauguucggacucaaacagcgucccacaccuucuagagaugcaguagugccacccuacaugcuggaccuguauaggcggcacucgggccagccugguucaccagcccccgaucaucgccucgagagagcugcaagcagggccaacacuguccggaguuuucaccaugaagaguccuuagaggaacugccugagacgucugggaagaccacacgccgauucuuuuucaaucuuagcuccaucccaacugaagaguuuauuaccucagcugagcuucagguguucagagaacaaaugcaggacgcccugggaaacaauaguagcuuucaccauaggauaaacaucuacgagauuaucaaaccggcgacagcaaauucuaaguuccccguuacccggcuacucgauacucgucuggugaaccagaaugccucccgcugggaaucauuugacgucaccccugcugugaugagauggacagcccagggccacgcaaaccacggcuucguaguugagguggcucaucuugaagagaaacaaggggucagcaagaggcacgugcggauuagucgaucucugcaucaggaugagcacuccuggagccagauccgcccauugcucgugacguuuggacacgacgguaagggccauccccugcacaaaagagaaaagaggcaggccaaacauaagcaacggaaacgcuuaaagucgucuuguaagagacacccucuguaugucgauuucuccgacguuggguggaaugauuggauaguggcgccacccggauaccaugccuucuauugccacggcgaguguccguuuccucucgcagaccaccuuaacucaacuaaucaugcuaucguacagacccuggugaacagugucaauagcaaaauucccaaggccugcugugugccaacagaauuguccgcuaucucuaugcuauaccuggaugagaacgaaaaaguugugcucaagaauuaucaggacauggucguggaggguugcggguguaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4121 - RNA, 1574 nt, Artificial Sequence
  mRNA product Design3 comprising derived and/or modified sequence from Homo sapiens__NP_001193.2__HsBMP4 (opt3)
gggagagucccgcagucggcguccagcggcucugcuuguucgugugugugucguugcaggccuuauucaagcuuaccaugauccccggcaacagaaugcugauggugguccuccuuugccagguucuguuagggggagccagccacgcuuccuugauuccugagaccgguaagaaaaagguggcagaaauacaaggccaugccgggggaaggcggucuggccagucacacgagcugcuacgcgacuucgaagcgacacuccugcagauguuuggucuucgacguagaccacagccgaguaaaagcgcuguaauccccgauuacaugagggaccuguaucgguugcaauccggggaggaagaggaggaacagauucauucuacuggacucgaguacccugaacgcccagccucgagagcaaauacggugaggucauuccaccaugaggagcaccuggaaaacauccccggcaccagcgagaauagugccuuucgguuccuguuuaaccucuccucuauuccugaaaaugaggucaucagcuccgcugaauuacgccuguuccgagaacagguggaucagggcccagacugggagagaggguuucacaggauaaacaucuaugagguuaugaagcccccugcagagguggucccaggacaucuuauuacacgguugcuggauacucgucuagugcaccauaauguaacccgcugggaaacauucgacguuucaccggccgugcucagauggaccagggagaaacaacccaacuacggucuggcuaucgaagucacucaccuucaccagacacggacccaucagggccagcacgugcgaauuagucgcagccugccucaagggucuggaaauugggcccaguugagaccacuccuggugacguuuggccaugaugguagggggcacgcguuaacucggcgcagaagggcaaagcguucccccaagcaucacucacagcgggcccgaaagaaaaacaaaaauuguagaaggcacagccuguaugucgacuucagugauguuggauggaacgacuggaucguggcuccuccaggcuaccaagccuuuuauugccauggcgauugucccuucccgcucgcagaccaccuuaauucuaccaaccaugcuauaguacagacacuggucaauuccgugaacagcucgauuccuaaggccugcugugugcccacugaguugucugcgaucuccaugcuauaccuggaugaguacgacaaaguugugcucaagaacuaucaggaaauggucguggaggggugcggaugucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4122 - RNA, 1889 nt, Artificial Sequence
  mRNA product Design3 comprising derived and/or modified sequence from Homo sapiens__NP_001709.1__HsBMP6 (opt3)
gggagagucccgcagucggcguccagcggcucugcuuguucgugugugugucguugcaggccuuauucaagcuuaccaugcccggccuagggagaagggcccaguggcucugcuggugguggggacuucuguguagcugcugugguccuccaccguugcggcccccuuuaccagcugcagccgcggcugccgcaggcgggcaacugcuaggagacggcgguucccccgggcgcaccgagcagccuccacccucuccucagucaaguagcggauuccucuaccgacgucugaagacacaggagaaaagagaaaugcaaaaggaaauccuuuccgugcugggcuugccacacaggccgcggccccuccauggccugcagcagccucagccacccgcccugcgccaacaggaggaacagcagcaacagcagcaacucccuagaggggagccacccccgggaagguuaaaaucugcuccucuguuuaugcuugauuuguauaacgcacugucggccgacaaugaugaggacggugcuucagaaggcgagcggcagcagagcuggccccacgaagccgcgaguuccucucagcgccgacaaccaccucccggggcagcccauccacuaaacagaaagagccuccuggcucccggauccggcucagguggggccaguccucuuacuagcgcacaggauucugcuuuccugaaugacgccgauauggucauguccuuuguuaacuugguggaguacgacaaagaguucucaccaaggcagcggcaccauaaggaauuuaaguucaaucucagccagauuccggagggagaaguagugacggcggccgaguuucguauauauaaagauugcgucaugggcaguuucaagaaccaaaccuuucugaucucuauuuaccagguguuacaggaacaccagcaccgcgacuccgaucuguuccuccuugacacaagaguugugugggcaagcgaggagggcuggcuggaauuugauaucacugcuaccucgaauuugugggucgugacaccccaacauaacauggggcuacagcugucuguaguuaccagggacggagugcacguccauccucgggccgcuggucucgugggccgagacgggccauaugauaaacagcccuucaugguggccuuuuucaaggucuccgagguucacgugcgcacuacaagaucagcaaguagcaggcggcgccagcaauccagaaauaggucuacccagagccaggacguagcccgugugucaagugcuuccgauuacaacagcucugaacugaaaacggcgugucggaagcacgagcuuuaugucucauuccaagaccugggauggcaggauuggauuaucgcaccuaagggcuacgccgcuaauuacugcgacggugaauguaguuuuccauugaacgcccauaugaaugcaacuaaccacgccauagugcagacccucguucaucugaugaaucccgaguaugugccgaaaccuugcugugcuccaacaaaguuaaacgccaucagcguccuguacuucgaugacaacuccaaugugauucugaaaaaguaucgaaacaugguaguuagagcaugcgggugucacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4123 - RNA, 1643 nt, Artificial Sequence
  mRNA product Design3 comprising derived and/or modified sequence from Homo sapiens__NP_001710.1__HsBMP7 (opt3)
gggagagucccgcagucggcguccagcggcucugcuuguucgugugugugucguugcaggccuuauucaagcuuaccaugcacgugagaagccugagggccgcugcaccccauuccuucgucgcccucugggcgccucuuuuucuguugcggucugcuuuagccgacuucucacuggauaacgagguucacaguagcuuuauccaucgccgacuacguucccaggaaagaagggagaugcaacgggaaauucucucuauacugggccuuccacaccgcccgagaccccaucugcaggggaagcacaauucggcaccuauguucauguuggaccucuacaacgccauggcuguggaggaaggagguggcccagggggacagggcuuuucauaucccuacaaagcaguauucagcacccaggguccuccacuggccagucugcaagauucccacuuucucacagacgcugauauggugaugucuuucgucaauuuaguggagcaugacaaggaguuuuuccaccccagguaucaucaccgggaauuucgcuucgaucugagcaaaaucccugagggggaagccguuacugcggcagaguuucgaauuuacaaggacuauaucagagagagguucgauaacgaaacguuccggauuuccguguaccagguccuucaggagcacuugggacgugaaucagaccuguuucuacucgauagucgcacccugugggccagcgaggaaggcuggcuuguguucgacaucacagcuacuucuaaucauuggguaguuaacccaagacacaaucugggcuugcagcucuccguggagacccuggaugggcaaucaauaaacccgaaauuagccggacugaucgguaggcauggcccccagaauaagcagccuuuuauggucgcauucuuuaaggcuacagaggugcacuuccggagcauucgaaguaccgggucuaaacagcgcucccaaaacagaagcaagacucccaaaaaucaggaagcccucaggauggcgaacguggccgaaaauucgucuuccgaccagcggcaagcaugcaagaaacaugagcuuuaugucucauuucgcgaccugggauggcaggauuggaucauugcuccagagggcuacgccgcuuacuauugugaaggugagugcgccuucccuuugaacaguuacaugaaugcaacaaaccacgccaucguucagacccuagugcacuuuauaaacccagagacgguacccaagccguguugcgcuccuacucagcugaaugcgauuagcgugcucuauuucgacgauuccucuaacgucauccugaagaaauacagaaauauggugguuagggcaugugggugccauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4124 - RNA, 647 nt, Artificial Sequence
  mRNA product Design3 comprising derived and/or modified sequence from Homo sapiens__NP_006264.2__HsCCL7 (opt3)
gggagagucccgcagucggcguccagcggcucugcuuguucgugugugugucguugcaggccuuauucaagcuuaccaugaaggccagcgcugcacugcucugccuucuguugaccgccgcggcuuucucuccccagggcuuagcccaaccuguggggaucaacacauccacuacguguugcuacagauuuauuaauaaaaagauaccaaaacagaggcuggagucauaucggcgcaccacaaguagccacuguccgcgagaagcagucaucuucaagacuaaacuagacaaggagauuugcgccgaucccacccagaaguggguucaggacuuuaugaaacaucucgauaagaaaacacaaaccccuaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4125 - RNA, 3971 nt, Artificial Sequence
  mRNA product Design3 comprising derived and/or modified sequence from Homo sapiens__NP_001954.2__HsEGF (opt3)
gggagagucccgcagucggcguccagcggcucugcuuguucgugugugugucguugcaggccuuauucaagcuuaccaugcugcucacccuuaucauucuguugcccguggucagcaaguucuccuuuguuucuuuaucagccccucagcacuggaguugcccagagggcacacuggcugggaacggaaauagcacuuguguggguccggcacccuuccuaauauuuucccauggcaacucuaucuucagaauugacacggaagggaccaauuacgagcaacucguaguggacgccggagucucggugaucauggacuuucacuauaacgaaaagaggauuuacuggguugaucuggagcggcagcuucugcagcgcguguucuugaauggcucacgacaggaacgugucugcaacaucgagaagaaugugagcgguauggcgauaaacuggaucaaugaggaaguaauuuggaguaaccaacaggaggggaucauuacaguuacugacaugaaaggaaauaacucccauauccuccugucugcucugaaguauccugccaauguggcagucgauccaguggaaagauuuauauucuggagcuccgagguggccggcucacucuacagggcugacuuagauggcgucgggguuaaagcacugcuugagaccagugaaaagauuacagccgugagcuuggacguacuggauaagcggcuauuuuggauccaguauaaccgcgagggaucuaauucccucauuuguucaugcgacuacgaugguggcagcgugcacaucaguaaacaucccacccagcacaaccuguucgcuaugucucuuuuuggggacagaaucuucuauuccacuuggaagaugaaaacaauuuggauagccaacaagcacaccggaaaagauauggucaggaucaaucugcauagcucguuugugccuuugggcgaacucaagguugugcacccacuggcgcaacccaaggcagaggacgacacgugggaaccugagcagaaauuauguaagcugcggaaagguaacugcucauccacugucugugggcaggaucuccagucacaucuuugcaugugugccgagggauacgcucugagucgcgaccgaaaguacugcgaagaugugaaugagugugccuucuggaaccacggcugcaccuugggcugcaaaaauacaccagggagcuauuacuguacuugcccgguaggauucguucuacugcccgacgguaagagaugucaccaacucguguccugcccuaggaacgucucugaauguagccaugauugcgugcugaccucagagggcccacuuuguuuuugccccgaagggaguguccuggagcgggacggaaaaacauguuccggcugcagcucuccugauaaugguggguguucacaguugugcgugccacucagucccguuagcugggagugcgacuguuucccgggcuaugaucugcaguuagacgaaaaguccugcgcagcuucuggaccucaacccuuucugcuauucgccaacucgcaggauauucgucacaugcauuuugacggcaccgacuacgggacgcuccugagccagcagaugggaaugguguaugcgcuugaucacgacccaguagagaauaagaucuacuucgcccauacugcauugaaauggauagaacgcgcuaacauggaugguucccaaagagagaggcugauugaagagggcgucgacgugccugaggggcucgccguugauuggaucggacggcgauuuuauuggacagaccgcggcaagucacugaucgguagaagugaucuuaaugggaaaaggucuaagauuaucaccaaagaaaacauuagccagccccggggcauagcugugcacccaauggccaagcgccuguucuggacugacacaggaaucaaucccagaauugaguccucuagcuugcagggccucgggaggcuggucaucgcaucuuccgauuuaaucuggccuaguggaauuaccauagacuuucugacggauaagcuauacuggugugacgccaaacagagcgugaucgaaauggcuaaccucgaugguucuaagcgucggcgacugacccaaaaugacguaggccacccauucgcgguggcaguuuuugaggacuacgucugguucuccgauugggccaugccgucagugaugagagugaacaaaaggacagggaaggaccgcguccggcuucagggaaguauguugaaacccagcucgcugguuguggugcauccucucgcuaagccaggcgccgaucccugccuguaucagaacggugggugugagcacauuugcaagaaaagauuaggcacugcaugguguuccugcagggaaggauuuaugaaggccucugacggcaaaaccugucuggcucuugaugggcaucaguugcucgccggaggcgagguagaccugaagaaucaagucacaccucuagauauccugagcaaaacucgcgugucagaagacaacauuaccgagagucagcacaugcucguugcagaaaucaugguguccgaucaggacgauugcgcgccagucgguuguucuauguacgcucgaugcauaagcgagggggaggacgccacaugccagugucugaagggauucgcaggcgaugguaaacuuugcuccgacaucgacgaaugugagaugggcgugcccguuugcccgccugccucaagcaaauguauuaauaccgaagggggauaugugugccgguguagugagggcuaccaaggggauggaauccacugcuuggacauugaugaaugucagcugggcgagcauucuugcggugagaacgcuuccuguacuaauacggaagggggauauacaugcaugugcgccggccguuuaagcgagccaggucucaucugucccgacucgaccccucccccacaccugagagaagaugaccaucacuacucaguaaggaacucugauagugagugcccucuuucccaugacggcuauugucugcacgauggggucugcauguacauagaagcauuggacaaguacgcuuguaauugcguggugggauauauuggcgagcgcugucaguaccgggaucucaaauggugggagcugagacacgccgggcauggacaacagcagaaggucaucguuguggcgguaugcguggucgugcuaguuaugcugcuccugcuuagcuuguggggcgcccacuauuacaggacucagaaacuguuaucuaagaaccccaaaaauccauaugaagagagcucccgagacgugcgcucacggagaccggcugacaccgaagaugguaugaguagcuguccucaacccugguucgucgugauuaaggagcaucaggaccucaagaacgggggacagccaguugcaggcgaggauggucaggccgcugacggcucuaugcaacccacauccuggaggcaggaaccucagcugugcgggaugggaaccgagcagggcuguuggaucccagugucaagugauaaagggagcugcccccaagucauggaacguuccuuucacaugccuucuuacggaacucagacacuugagggcgguguagaaaagccgcauucgcugcuaagcgccaauccacucuggcagcaacgcgcacuggaucccccucaccagauggaguugacgcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4126 - RNA, 857 nt, Artificial Sequence
  mRNA product Design3 comprising derived and/or modified sequence from Homo sapiens__NP_001423.1__HsEREG (opt3)
gggagagucccgcagucggcguccagcggcucugcuuguucgugugugugucguugcaggccuuauucaagcuuaccaugaccgccggcagaaggauggagaugcugugcgcugggcgggugcccgcacuccuucuguguuugggauuccacuuacugcaggccguccuaagcacaacuguuaucccuuccugcauuccaggugaaucuucagacaacuguacggcgcucgugcaaaccgaggauaauccgcgcguagcucaggugaguauaacaaagugcagcuccgacaugaacggcuacugucugcaugggcagugcaucuaucuugucgauaugucucagaauuacugucgaugcgaagugggauauacuggcguucguugugagcacuuuuuccugaccgugcaucaacccuugucgaaagaauacgucgcccucacagugauucugaucauucuguuucucaucaccguaguugguucaacuuauuacuucugcagaugguauaggaaccgcaagagcaaagagccuaagaaagaguacgaacgggugacaaguggggacccagaguuaccccaggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4127 - RNA, 815 nt, Artificial Sequence
  mRNA product Design3 comprising derived and/or modified sequence from Homo sapiens__NP_000791.1__HsFGF1 (opt3)
gggagagucccgcagucggcguccagcggcucugcuuguucgugugugugucguugcaggccuuauucaagcuuaccauggccgagggcgaaaucaccacauucacugcucugacggagaaguuuaaccuucccccugggaauuacaaaaagccaaaacuccuguauugcagcaacggaggucacuucuugagaauuuuaccggacggcaccguggaugggacaagggaccgguccgaucagcauauacaacugcagcuaucugcagaaucagucggagagguuuacaucaagaguacugaaaccggccaguaucucgccauggacacagauggucugcuuuacgggagccagacccccaaugaggagugucuguuuuuggaacgccucgaggaaaaccacuauaauacuuacauuuccaaaaagcaugcggagaagaacugguucgugggacugaaaaagaauggcucuugcaaacgaggcccucguacacacuaugggcaaaaggcuauccuguuucucccauuacccguaucgucagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4128 - RNA, 1214 nt, Artificial Sequence
  mRNA product Design3 comprising derived and/or modified sequence from Homo sapiens__NP_001997.5__HsFGF2 (opt3)
gggagagucccgcagucggcguccagcggcucugcuuguucgugugugugucguugcaggccuuauucaagcuuaccauggugggcgucgggggaggugacguugaggaugugacccccagaccuggcgggugccagaucagcggaaggggcgcccgggguuguaacgggauuccaggagcugcagccugggaagcggcucugccgcgccgacgucccagaaggcacccuuccguaaauccacggucucgcgccgcaggcucacccagaacaaggggccggcgcacugaggaacgaccuagugggagcagacucggagacaggggucggggccgugcccuuccagggggacgccugggcgguagagggaggggacgggcucccgagcgagugggcggccgcgggagaggaagggguacggcagccccucgggcugccccagcggcacgcggcuccagaccggggcccgccggaaccauggcugccggcucuauaacaacuuugccugcauuaccagaagauggugggucgggcgcuuuucccccuggacauuucaaggacccaaaaaggcuguacugcaagaacggcggguucuuucuacguauccaccccgauggacgggucgacggugugcgagagaaaucagauccgcauauuaagcuccaacugcaggccgaggaaagaggcguugugagcaucaaaggggucugugcgaauagguaucuugccaugaaggaggacggacgccuguuggcaaguaagugcgugaccgaugaauguuucuuuuucgagcggcucgaguccaacaauuacaacacauauagaucuaggaaauacaccagcugguauguagcucugaagcgcacuggccaguacaaacuggguuccaagacagggccuggccagaaagccauucucuuuuuacccaugucagcuaagaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4129 - RNA, 932 nt, Artificial Sequence
  mRNA product Design3 comprising derived and/or modified sequence from Homo sapiens__NP_002000.1__HsFGF7 (opt3)
gggagagucccgcagucggcguccagcggcucugcuuguucgugugugugucguugcaggccuuauucaagcuuaccaugcacaaguggauccugaccuggauucuccccacacuucuguacagaagcugcuuccauauaaucuguuuggugggcacuauuuccuuagccugcaacgacaugacgccugagcagauggcuaccaaugucaacuguucuucaccagaaaggcacacacggaguuaugauuacauggagggaggagacauccgcguucgacgucuguuuugcagaacucaaugguaucuaaggauugauaaacgggguaaggugaaaggcacccaggaaaugaagaauaacuacaauaucauggagauacgcacaguagcaguggggaucgucgccauuaaaggaguggaaagcgaguucuaucucgcgaugaacaaggagggcaagcuguacgcuaaaaaggaauguaaugaggacugcaacuuuaaagaacuuauccuggagaaucauuauaacaccuacgccuccgcaaaguggacucacaaugguggggagauguucguugccuugaaccagaaagggauuccggugagaggcaagaagaccaaaaaggaacagaaaacagcucauuuucuccccauggcaaucacgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4130 - RNA, 974 nt, Artificial Sequence
  mRNA product Design3 comprising derived and/or modified sequence from Homo sapiens__NP_001936.1__HsHBEGF (opt3)
gggagagucccgcagucggcguccagcggcucugcuuguucgugugugugucguugcaggccuuauucaagcuuaccaugaagcugcuccccagcgugguccuuaaacuguucuuggccgcuguuuuauccgcacuggugaccggcgagucucuagaaagacucaggcgggggcuggccgcgggaacaucaaacccugacccaccgacuguaaguacggaucagcuucugcccuuggguggcgggcgcgaccgaaaggugcgugaucuccaagaggcugaccuggaucugcucagagucaccuuaagcuccaaaccucaggcccuggcaacaccaaauaaggaggaacacggaaaaaggaagaagaaaggcaagggucuugggaaaaagcgggaccccugcuugcgcaaauacaaggauuuuuguauccauggagaaugcaaguaugugaaagagcugagagccccuucuuguauuugccacccaggcuaccauggcgagaggugucacgggcuaucgcuccccguugaaaaccggcuguauacuuacgaccauaccacaauacuugcuguggucgcagugguacugucaagcguuugcuugcucgugaucgucggacuguuaauguuccgcuaucaccgaagagguggcuacgauguggagaaugaagagaaggugaaacuggggaugaccaacagucacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4131 - RNA, 2534 nt, Artificial Sequence
  mRNA product Design3 comprising derived and/or modified sequence from Homo sapiens__NP_000592.3__HsHGF (opt3)
gggagagucccgcagucggcguccagcggcucugcuuguucgugugugugucguugcaggccuuauucaagcuuaccaugugggugaccaagcugcuccccgcccuucuguugcagcacgucuuacugcaucuacuccugcuuccuaucgcuauuccauacgcagagggccaaagaaaaaggcggaacacaauacacgaguucaagaaaagcgccaagacuacgcugaucaaaauugacccggcguugaagaucaagaccaaaaagguuaauacagcugaucagugcgccaaccgcuguacucgaaauaaagggcuccccuuuaccugcaaggcauucguguuugacaaagcccguaagcagugucugugguucccuuuuaacuccaugucuucaggaguaaagaaagaguucggucaugaauuugaucuguaugagaauaaggacuacauuagaaacugcaucauaggcaaagggaggaguuauaagggaacagugagcaucaccaaauccggcauuaagugucagccauggucuucgaugaucccccacgaacauucauuccucccuagcaguuaccgggguaaagauuuacaagagaauuauugccgcaacccaagaggggaggaaggaggccccugguguuuuacuuccaauccugaggucagguacgaagugugcgacauuccacaguguucugagguugagugcaugacauguaacggcgaaagcuaucgggggcugauggaucacaccgaguccggaaagaucugccagcgcugggaccaccagacgccgcaucgacacaaguuccuucccgaaagauacccugauaaagguuuugacgauaauuacugcaggaacccagacggccaaccccggccuugguguuauacuuuggauccacauacccguugggaauacugcgcuauaaagacaugugcagacaauacuaugaacgacaccgaugugccccuggaaacaaccgagugcauucaggggcagggagagggcuaucgcgguacggucaauacuaucuggaacgggauuccgugucagagaugggacucacaauacccucacgaacacgauaugacacccgagaacuucaaaugcaaggaccuaagggaaaauuauugucggaacccagauggaagugagagcccuuggugcuuuaccacugaccccaauauccgagugggcuacuguucucagaucccaaacugcgauaugucccauggccaggacuguuaucgcgggaaugguaaaaacuacaugggaaaucucucacaaacaagaagcggccugaccugcaguaugugggauaagaacauggaagaccuucacaggcauauuuucugggagcccgaugccucuaagcugaaugagaacuacugccggaauccugacgacgaugcucacgggccaugguguuauacgggaaacccguugauacccugggacuacugcccuaucucccgcugugaaggcgauaccacaccaacuauuguaaaucucgaccaucccguuaucagcugcgccaaaaccaagcagcugagaguggucaacgguauaccuacaaggacuaauauuggguggauggugucguuacguuaucggaacaaacacaucuguggcggaucucugaucaaggaguccugggugcucaccgcgcgacagugcuucccaucaagagaucuuaaagacuacgaagcauggcugggcauucacgauguccaugggaggggagacgagaaguguaagcagguuuugaacgugagucagcuaguauauggucccgaaggcagcgaucuggugcucaugaaacuggcccgcccggcuguccuugacgauuuuguguccacaaucgaccugccuaauuacgggugcaccauuccagagaagacuucuuguagcguuuauggauggggcuacacggguuugauaaacuacgaugggcuccugcggguggcccacuuauauaucaugggcaaugagaaaugcucacaacaucacagaggaaaggucacacugaacgaaagugagauuugugcaggcgcugagaaaaucggguccggacccugcgaaggugacuacggcgggccucuagugugcgagcagcacaagaugaggaugguacucggaguuaucgugcccggccgcgguugugccauuccaaaucgaccugggauauucguccggguggcguauuacgccaaguggauccauaaaauuauccugaccuauaaggucccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4132 - RNA, 2273 nt, Artificial Sequence
  mRNA product Design3 comprising derived and/or modified sequence from Homo sapiens__NP_005336.3 __HsHSPA1A (opt3)
gggagagucccgcagucggcguccagcggcucugcuuguucgugugugugucguugcaggccuuauucaagcuuaccauggccaaggcugcagccaucggcauugaccuggggaccacauacagcugcgugggagucuuccagcacgguaaaguugagauaaucgcgaacgaucaaggcaauagaacuacgcccuccuauguggcuuuuaccgacacagaaaggcucauuggggaugccgcaaagaaccagguagcccuuaauccucagaacacuguguucgacgcuaaacggcugaucggacgcaaguuuggcgauccagucgugcagucugacaugaaacauuggccguuccaaguuauuaaugauggugacaagcccaaggugcaggucucauacaaaggggagaccaaggcauuuuauccugaagagaucaguagcaugguguugacaaaaaugaaggaaauagccgaggcuuacuuaggauauccaguaaccaacgccguuaucacugugcccgcguacuucaaugauucccagcgacaggcaacaaaagacgccggcgucauugcuggccugaacgugcuacguaucauuaaugagccuaccgccgcagcuaucgccuaugggcucgauagaacgggaaagggugaaaggaacgugcugauauuugaccuuggcgggggaacuuucgaugucucuauucugaccaucgacgacggcauuuuugagguuaaggcgacagccggugauacucaccuugggggagaagacuucgauaaucggcucgugaaccauuuuguagaggaguucaaacgcaagcacaaaaaggacaucucgcaaaauaaaagagcagugaggcggcugcgcaccgcuugugaacgagccaagagaacacugucaagcaguacccaggcuucccucgagaucgauucuuuauuugaaggcauugacuucuacacgagcauaacuagggcccgguucgaggaacugugcuccgaucuuuuucguucaacauuggagccagucgagaaagcacugcgcgacgccaagcuagauaaggcucagauccaugaccucgugcugguuggcgggaguacccggauucccaaagugcagaaguugcugcaagauuucuuuaacggaagggacuugaauaaaagcaucaacccugacgaagcggucgcauacggugccgcugugcaggccgcaauacucaugggcgauaagucugagaacguacaggaccuguuacugcucgauguugccccacuuucccugggguuggaaacugcuggaggcgugaugacagcccuaauuaaaagaaauucaaccaucccgacgaagcaaacccagaucuucacaacuuauagcgacaaccagcccgguguccugauucagguguacgagggggaacgagcaaugaccaaggauaauaaccuccugggccgcuuugagcuuaguggaaucccuccagcgcccagaggcgucccucaaauugaggugacauucgacauagaugcuaaugggauccugaacguuacugccaccgacaaaucuacaggaaaggcaaauaaaauuaccaucacuaacgauaaggguagguuguccaaagaagagaucgaacggauggugcaggaggccgaaaaguauaaggcugaggacgagguacagcgcgaaagagucagcgccaaaaaugcacucgagucguacgcuuuuaacaugaagucugccguggaagaugagggccugaaagggaagauuuccgaggcggacaaaaagaagguuuuagauaaaugucaggaagugauaucauggcuggacgccaauacgcuagcugagaaggacgaguucgaacacaaaaggaaggaacucgagcaagucugcaacccaaucauuaguggacuguaucagggcgccggugggcccggcccgggaggcuuuggggcacagggaccuaaagguggcagcggguccggacccacaaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4133 - RNA, 2273 nt, Artificial Sequence; identical to SEQ ID NO: 4132
  mRNA product Design3 comprising derived and/or modified sequence from Homo sapiens__NP_005337.2 __HsHSPA1B (opt3)

SEQ ID NO: 4134 - RNA, 2273 nt, Artificial Sequence
  mRNA product Design3 comprising derived and/or modified sequence from Homo sapiens__NP_005518.3 __HsHSPA1L (opt3)
gggagagucccgcagucggcguccagcggcucugcuuguucgugugugugucguugcaggccuuauucaagcuuaccauggccaccgcuaagggcaucgcaauugggauagaccugggaacaacuuacagcugcgugggugucuuccagcacggcaaaguugagaucauugccaacgaucaagggaauagaacgacccccuccuauguggcguuuacagacacugaaaggcucaucggagaugcugccaagaaccagguagcaaugaauccucagaacaccguguucgacgccaaacggcuuauuggccgcaaguuuaaugauccagucgugcaggcugacaugaaacuguggccguuccaaguuaucaacgagggugggaagcccaagguguuggucucuuacaaaggagaaaauaaggcauuuuauccugaggaaauaucaaguaugguguuaacaaaacugaaggagaccgccgaggcuuuccuaggccauccaguaacuaacgccguuaucacagugcccgcguacuuuaaugauagccagcgacaggcaaccaaagacgccggcgucauugcugggcucaacgugcugcguaucauuaaugaaccuacggccgcagcuaucgccuauggacuugauaaggguggccagggggagagacacgugcugauauucgacuugggaggcgguacuuuugaugucuccauucucaccaucgacgaugggauuuucgaaguuaaggcgacagccggagacacucaucugggcggcgaggacuuugauaacaggcuggugucucacuucguagaggaauuuaaacggaagcauaaaaaggacaucucgcaaaauaaacgcgcagugagaaggcuccggaccgcuugugagcgcgccaagcgaacauuaucaagcaguacccaggcuaaccuggaaaucgauucccuuuacgaggggauugacuucuauacgucuauaacuagagccagguucgaagaguugugcgcagaucuguuucggggaacacuagagccagucgaaaaagcccuccgugacgcuaagauggauaaggcgaaaauccacgacauugugcugguugguggcagcacccgcauccccaaggugcagagacuucugcaggauuacuucaaugggagggacuugaacaaauccauaaacccugaugaggcagucgccuacggagcugccgugcaagcagccauucucaugggcgacaagucagaaaaaguacaggaccuguuacugcucgauguugcuccacuuagucuggguuuggagacugccgggggcgugaugacagcacuaaucaagcggaauagcaccaucccgacgaagcagacccaaauuuuuacaacuuauucugacaaccagcccggaguccugauccagguguacgaaggcgagcgagcgaugaccaaagauaauaaccuccuggggcgcuucgaccuuacagggauuccuccagcucccagaggugucccucagauagaggugacuuuugauaucgacgccaauggcauucugaacguuaccgcaacagauaaguccaccgggaaagugaauaagaucacuaucacgaacgacaaaggaagguugucaaaggaagagauugaacggaugguacucgaugccgagaaguauaaagcugaagacgagguccaacgcgagaagauagccgcuaaaaaugcacuggaaagcuacgccuucaacaugaagagugugguuucugaugagggcuuaaaagguaagaucuccgaaagcgacaagaauaaaauucuggauaaguguaacgagcuacucucguggcuggaggugaaucagcuugcggaaaaagacgaguuugaccacaagagaaaagaauuggagcagaugugcaacccaaucauuacaaagcuguaucagggaggcuguaccggacccgccugcggcacuggguacgucccgggaaggccugcuaccggucccacaaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4135 - RNA, 2267 nt, Artificial Sequence
  mRNA product Design3 comprising derived and/or modified sequence from Homo sapiens__NP_068814.2 __HsHSPA2 (opt3)
gggagagucccgcagucggcguccagcggcucugcuuguucgugugugugucguugcaggccuuauucaagcuuaccaugagcgccagaggccccgcuaucgggauugaccugggaaccacauacuccugcgugggugucuuccagcacggcaagguugagauaaucgcaaacgaucaagggaauaggacuacgccuucuuauguggccuuuaccgacacagaacggcucauuggagaugcggcuaaaaaccagguagccaugaauccaacuaacaccaucuucgacgcaaagcgccuuauuggccgaaaauuugaggaugccacagugcagucagacaugaagcauuggccguuccgugucgugagugaaggugggaaacccaagguucagguggaguacaagggagaaaccaaaacauuuuucccugaggagaucagcuccaugguccugacuaagaugaaagaaauagcugaggcauauuugggcggcaaggugcacucugccguaaucaccguuccagcuuacuuuaaugauucgcaaagacaggccacgaaagacgcggggacuauuaccggauuaaacgugcugaggaucauuaaugaacccacagcagccgcuaucgccuauggucuagauaagaagggcugugcagggggagagaaaaacguccucauauucgaccugggcggugggacuuuugaugugucaauucuuaccaucgaggacggaauuuucgaagucaagagcacagcuggcgauacccaucugggcggggaggacuuugacaaucggauggugagucacuuggccgaagaguucaaacgcaagcauaaaaaggauaucggaccuaacaaaagagcgguuaggcggcuccgcacggccugcgaacgagcaaagagaacucuguccucuagcacacaggcuuccaucgagauugacucacuguacgaggguguggauuuuuauaccaguauaacuagggcccgguucgaggaacucaaugcugacuuauuccguggcacacuggaaccaguagagaaggcccuucgcgaugcaaaauuggacaaggggcagauccaagaaauugugcuggucggaggcagcaccagaauccccaaaauacagaagcuacuccaggacuuuuucaacgguaaagagcugaauaagucuauuaacccugaugaggccguggcuuacggggcggcaguucaggccgcuauccuuaucggcgauaaguccgaaaaugugcaagaccuguugcuccuggaugucacgccauuaucacugggaauugagaccgccggcggggugaugacaccgcucaucaaaaggaacacuaccauucccacaaagcagacucagaccuuuacaaccuacagcgacaaccaaaguucuguacuuguucagguguaugaaggagagcgggcaaugacuaaagacaauaaccuguuggguaaguucgaucuaacgggcauaccuccagcuccccgaggggucccucagaucgaagugacauuugacauugaugccaauggaauccugaacgucaccgccgcagacaaauccacuggcaaggagaauaagaucaccauuacaaacgauaaaggucgccucagcaaggacgauauagacagaauggugcaggaggcggaaagguacaaaucggaggaugaagcuaaucgggaccgcguugccgcaaagaacgcccuggagucuuauaccuacaauaucaaacaaacuguggaggaugaaaaacuuagagggaagauuuccgagcaggacaagaacaagauccuggauaaaugucaggaaguaauuaauugguuggacaggaaccagauggcugagaaggacgaauaugagcacaaacaaaaggagcucgaacgugucugcaauccaaucauaucaaaacuguaccagggcggacccggcgggggaagugguggcgggggaagcggcgccuccggugggccgacaaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4136 - RNA, 2870 nt, Artificial Sequence
  mRNA product Design3 comprising derived and/or modified sequence from Homo sapiens__NP_002145.3 __HsHSPA4 (opt3)
gggagagucccgcagucggcguccagcggcucugcuuguucgugugugugucguugcaggccuuauucaagcuuaccaugagcguggucggcaucgaccugggguuccaguccugcuacguugccguggcuagagcaggagguauugagaccauagccaacgaauauucugauagguguacacccgcgugcaucucauuuggcccuaagaaucggaguauuggggcugccgcaaaaagccaaguaaucuccaacgccaagaauacugugcagggauucaaacgcuuucacggccgagcuuucucugacccauuugucgaggcagaaaagucgaaccucgccuacgauauugugcagcuuccgacgggucugaccgggaucaaaguuacauauauggaggaagaacguaauuucacuaccgaacaggugacagcuauguuguuaucaaagcugaaggaaaccgccgagagcguccucaaaaagcccgugguagacuguguugugagugucccuugcuuuuacacugaugcggaaagaagguccgugauggacgcaacacaaauagccggacuaaacugucugcggcuuaugaaugagaccacggcuguggcccuggcauauggcaucuacaaacaggauuugccagcucucgaggaaaagccccgcaacgucguuuucguggacaugggccauucugccuaucagguaagcgugugcgcguuuaauagagggaaacugaagguccuggccacugcauucgauaccacacucggagguaggaaguuugacgagguguuaguuaaccacuucugugaagaguuuggcaaaaaguacaaacuggauauuaaguccaaaauccgggcucuuuugcgccugucacaggaaugcgagaagcucaaaaagcuaaugagugccaaugcuagcgaccugccucuuucuauugaguguuucaugaacgauguggacgucuccgggacuaugaaucgaggaaaguuccuggaaaugugcaacgacuugcucgccagaguggagccaccccugaggucaguauuagaacaaaccaaacugaagaaagaggauaucuacgcaguugaaauagugggcggugccacacggauuccugcugucaaggagaaaaucagcaaguuuuucgggaaggagcucaguaccacgcuuaaugcggacgaagcagugacucguggaugugcccugcagugcgcuauuuugucuccagccuuuaaaguccgcgaguucuccaucacagaugugguuccguaucccaucagccuaagauggaacucgccugcagaagaggggucuuccgacugcgaaguguuuucaaagaaccaugccgcuccauucaguaaaguacugaccuuuuacaggaaggagcccuucacucucgaggccuauuacagcuccccucaggaucugccauaucccgacccggcaauugcgcaguuuucuguccaaaaagugacaccucagagcgauggcucaaguuccaagguuaaggugaaaguccgggugaauguacacggcauauucagcgugucuucagcuagucuuguugaaguccauaagagcgaggaaaacgaggagcccauggaaaccgaccagaaugccaaagaggaagagaagaugcaaguggaucaggaggagccacacguggaggaacagcagcaacagacgccugcagagaacaaagccgaauccgaggaaauggagaccucucaggcuggaucgaaggacaagaaaauggaucagcccccacaagccaagaaagcaaaggucaaaacaagcacuguugaccugcccaucgagaaucaguugcucuggcagauugaccgagaaaugcugaacuuauacaucgagaaugaagguaagaugauaaugcaggauaaacuggagaaggaacgcaacgacgcuaagaaugccguggaggaguauguguacgaaaugagagauaaacuauccggcgaguacgaaaaguuuguaucagaggacgauaggaacaguuucacccucaaacuggaggacacagaaaauuggcuuuaugaggauggggaagaccaaccuaagcaggucuacguggauaaauuggcggagcugaagaaccucggacagccaauuaagauccgguuucaggaaucugaggagcgcccgaaacuguucgaggagcuuggcaagcaaauccagcaguauaugaaaauuaucagcuccuucaagaauaaagaagaccaauacgaucaccuggacgccgcugauaugacuaagguugagaagucaaccaacgaagcaauggaguggaugaauaacaaauugaaccuccagaauaagcagagccugacaauggaccccguggucaaaucuaaggagauugaagccaaaauaaaggaguuaaccuccacuuguaguccuaucauuagcaagccaaaacccaagguggaaccuccaaaagaggaacagaagaacgcugagcaaaauggucccguugacgggcagggcgauaacccgggaccucaggccgcagagcagggcacggacacagcggugccaucugauuccgacaaaaagcugcccgaaauggauaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4137 - RNA, 2867 nt, Artificial Sequence
  mRNA product Design3 comprising derived and/or modified sequence from Homo sapiens__NP_055093.2 __HsHSPA4L (opt3)
gggagagucccgcagucggcguccagcggcucugcuuguucgugugugugucguugcaggccuuauucaagcuuaccaugagcguggucggcaucgaccugggguuccucaacugcuacauugccguugcuagauccggagguauagagaccaucgcaaaugaauauucugauagguguacacccgccugcauuucacuuggcagucggacucgcgcgaucgggaacgcugccaagagccagauugugacgaauguacgaaacaccauccacggauuuaaaaagcugcauggccguuccuucgacgauccuauagugcaaacagagagaaucagguugccauacgaauuacagaaaaugccgaaugguucugcaggggucaaggugcgguaucuggaggaagagagacccuuugccauugagcagguuacuggaaugcuacucgcuaaacugaaggaaaccucggagaacgcacuuaagaaaccuguggccgacugugucaucucaauucccagcuucuuuacagaugcugaaagaaggagugugauggccgcggcacagguagccggccugaauugcuugcggcucaugaacgagaccacugcuguugcccuggcauacggcaucuauaagcaagaccugccaccucucgaugagaaaccacgcaauguggucuucauagacauggggcacuccgcuuaccagguguuagugugugccuuuaacaagggaaaacugaagguccuugcgacaaccuucgaucccuauuuggguggccgaaauuuugacgaagcccugguugauuacuucugcgacgaguuuaagacgaaauacaagauuaacgugaaagaaaauucuagagcacuacucaggcuguaucaggagugugaaaaacuuaagaagcugaugagcgcuaacgccuccgauuugccucucaauaucgagugcuucaugaacgaccuggacguaucaaguaaaaugaaccgggcucaguuugagcaauuaugugccagccugcucgcacguguggaaccaccgcuuaaggccgucauggagcaggcuaaucugcagcgcgaagauauuucuuccaucgagaucguugggggagcgacucgcauucccgcagugaaggaacagauaaccaaauucuucuugaaggacaucucaacaacucuaaacgccgaugaggcuguggccaggggcugcgcacugcaaugugccauucucagcccugcuuuuaaaguccgggaguucaguaucaccgaccuggugccauacucuauaacacuucgauggaagaccuccuuugaagaugguagcggggagugcgaaguauucugcaaaaaucaucccgccccuuuuucgaagguuauuacguuccacaagaaagagccauuugaacuggaggcauucuauacuaacuugcaugaggugcccuacccggacgcgcgcaucggaucuuuuacaauccagaaugucuucccucaguccgauggcgacucaaguaaggugaaagucaaggugagaguuaacauucacggcaucuuuagcguggcuuccgccucuguaauugaaaaacaaaaucucgagggggaucacagcgacgcacccauggaaaccgagacuucauucaagaacgagaauaaggauaacauggacaaaaugcaggucgaccaggaagagggacaucagaagugucacgccgaacauacaccagaggaagagauagaucacaccggugcuaaaacgaagagugccguguccgacaaacaagauaggcugaaucagaccuuaaagaagggcaaaguuaagagcaucgaccugccuauucagucuucacuaugccggcagcucgggcaagaucugcuuaacaguuauaucgagaaugaaggaaaaaugaucaugcaggacaaguuggagaaagaacgcaacgaugcaaagaaugcuguggaggaauacgucuaugacuuuagagauaggcugggcacaguguacgagaaauucauuacucccgaggaccucagcaagcuguccgccguacuugaagauaccgagaacuggcuguacgaagacggugaggaucagccaaaacagguguauguugacaaguugcaagaacucaagaaauacgggcagcccauacagaugaaguauauggagcacgaggaacguccuaaagcgcugaacgacuuaggcaagaagauccagcuggucaugaaagugauugaggccuaccggaauaaggaugaacgauaugaccaucuagauccaacagagauggagaaaguggaaaaguguaucucugacgcuaugucguggcucaacagcaaaaugaaugcacaaaacaagcugucccuuacucaggauccggucguuaaggugucagagauuguggccaaaaguaaggaauuggacaauuucugcaaccccaucauauacaaaccuaagccaaaagcugagguacccgaagauaagccuaaggccaauucugagcacaacggaccaauggacggccagagcgggaccgagacaaaauccgauucaaccaaggacagcucucaacauacuaaauccaguggagaaauggaggucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4138 - RNA, 2312 nt, Artificial Sequence
  mRNA product Design3 comprising derived and/or modified sequence from Homo sapiens__NP_005338.1__HsHSPA5 (opt3)
gggagagucccgcagucggcguccagcggcucugcuuguucgugugugugucguugcaggccuuauucaagcuuaccaugaagcugagccucguggccgcuaugcuucuguuguuauccgcagccagagcggaggaagaggacaaaaaggaagaugucggcaccguuguggggaucgaccugggaacaacuuacucuugcguagguguguucaaaaacggcagggucgagauuauagcuaaugaucaggggaaccggaucacgcccucauauguggccuuuaccccugaaggagagcgccuaauuggcgacgcagccaagaaucaacucacaaguaacccagagaauacuguuuucgaugcuaaacgacugaucggucguaccuggaacgacccgagcgugcagcaggauauuaaguuucuucccuucaaggucguggaaaagaagacaaaaccuuacauccagguagacauagggggaggccaaaccaagacuuuugcaccagaggaaaucuccgccaugguucugacaaaaaugaaggagaccgcugaggccuauuugggcaagaaagugacgcacgcggucgugacugugcccgcauacuucaaugaugcccagagacaggcuaccaaggacgccgggacaauugcaggacucaacgucaugaggaucauuaaugaaccuacugcugccgcgaucgccuauggucuggauaaacgggagggcgaaaagaacauacugguuuuugaccucgggggaggcaccuucgaugugucuuuacugacaauugacaaugguguauuugagguggucgcaaccaacggggacacgcaucuuggaggcgaagauuucgaccagcgcgugauggagcacuuuaucaaauuguacaagaaaaagacuggcaaggauguuagaaaagacaauagggcugugcaaaagcugcggcgcgaggucgaaaaagccaagcgagcucuaucgucacagcaucaggccagaauugagaucgaaucuuucuaugagggggaagauuuuagugagacacucaccagggcaaaauucgaggaacugaacauggaccuuuuccgguccacuaugaagccagugcagaagguacuggaggauucugacuugaaaaagagcgauaucgacgaaauuguucucgugggagguuccacacguauacccaaaauccaacagcuggucaaggaguuuuucaauggcaaagaaccuucacgcgggauuaacccagaugaggccguggcuuacggagcggcaguccaggccggcguguuaaguggugaccaagacaccggggaucugguucuccuugacguguguccgcugacguugggcaucgagaccguaggaggcgucaugacaaagcuaauacccagaaacacugugguuccuaccaagaaaagccagauuuuuagcacagcuuccgauaaucagccaacugugaccaucaaggucuacgaaggggagaggccccugacaaaagacaaccaccuccugggaaccuucgaucuuacugguaucccuccagcaccccggggcgugccgcagauugaaguaacguuugagaucgacgugaaugggauucugcgaguuacagccgaggauaagggaaccggcaacaaaaauaagauaacuaucaccaacgaccaaaaucgcuugacaccugaagagauugaaagaauggucaacgaugccgagaaguucgcugaagaggacaaaaagcucaaagagaggaucgauacccggaaugaacuggagucauaugccuacagcuuaaagaaccagaucggugacaaagaaaagcuagggggcaaacugaguucugaggauaaggaaacuauggagaaggcaguggaggagaaaauugaauggcucgaaucccaucaggacgcggacauagaggauuuuaaggcuaaaaagaaagaacuggaggagaucgugcagcccauuaucagcaaacuuuauggaucggccggcccaccucccacaggggaagaggacacggcagaaaaggaugaguugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4139 - RNA, 2279 nt, Artificial Sequence
  mRNA product Design3 comprising derived and/or modified sequence from Homo sapiens__NP_002146.2__HsHSPA6 (opt3)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguucagaguugugagugaaggcgguaagcccaaagucaggguguguuaccgcggggaggauaagaccuuuuauccugaagagaucagcuccaugguacugucuaagaugaaagagacugcagaagccuaccuaggacagccaguuaagcacgcugugauuacaguccccgccuauuucaacgacucgcagcggcaggcgaccaaagaugcaggcgccaucgcuggccucaaugugcugagaauuaucaacgagccuacggccgcagcuauagccuacgggcuugacaggcggggagcgggugaacgcaaugugcugaucuuugauuugggcgggggaacuuucgacgucucaguucucagcauugaugccggcguguuugagguaaaggcaaccgcuggugacacacaucucgggggagaggacuucgauaaccgacuggugaaucacuuuauggaagaguucagaaggaaacauggcaaggaccugaguggcaacaagcgggccuuacgucgccugagaacugcuugcgaaagggccaaacggacccuuuccucuagcacacaagcaaccuuggagaucgauucccuguuugaaggggucgacuucuauacgucaauuacucgagcccgcuucgaggagcuauguagugaucucuuuagaagcacacuggaaccaguggagaaggcucuuagggacgcgaaacuggauaaggcacagauccacgacguuguguuggucggagguucuacccggauacccaaagugcagaagcuccugcaggauuucuuuaauggcaaagaauuaaacaaguccauuaauccugacgaggccguagcuuacggggccgcaguucaagccgcugugcugaugggagauaagugcgaaaaaguccaggaccuccuucuguuggacguggccccacuaucacugggccucgagacugccgguggggucaugacaacccugauccagcgcaacgcgacgauuccgaccaagcaaacacagacuuucaccacauacagcgauaaucagcccggcguguuuauccagguuuaugagggagaaagagcuaugacuaaagacaacaaccuucugggcagguucgaguugagugggaucccuccagcaccccguggagugccucaaauugaaguaaccuuugauauagacgcaaaugguauccucucugucacagccaccgaucgguccacuggcaaggcuaacaaaauuacgaucacaaaugacaaggggcgacugagcaaggaggaaguggagagaaugguucacgaggccgaacaguacaaagcagaggaugaagcucagagggaccgcguggccgcgaagaacucguuagaggcccaugucuuccacgugaaaggaucucugcaggaggaaucccuacgggauaagauaccagaggaagacagaaggaaaaugcaagauaagugucgcgagguacucgcuuggcuggaacauaaucagcuugcagagaaggaggaauaugagcaccagaaacgagaauuggagcagauuugccggcccaucuuuucacgucuguacggcgguccgggggugccuggcggaaguagcuguggcacccaagccagacagggggaccccuccacuggaccaaucauugaagagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4140 - RNA, 1451 nt, Artificial Sequence
  mRNA product Design3 comprising derived and/or modified sequence from Homo sapiens__P48741__HsHSPA7 (opt3)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacaggguaggguggaaauucuugcaaacgaucagggcaaucggacuacgccuuccuauguagccuuuaccgacacagagcgccuggugggggaugcggcuaagucucaggccgcauugaacccacacaauacugucuucgacgccaaacgauuaauaggacguaaguuugcugauaccacagugcaaucagacaugaaacauuggccguuccagguugugagugaaggcgguaagcccaaagucagaguguguuacaggggagaggauaagaccuuuuauccugaagagaucagcuccaugguacugucuaagaugaaagagacugcagaagccuaccuagggcagccaguuaagcacgcugugauuacaguccccaccuauuucucgaacucacagcggcaagccacgaaagacgcgggcgcaaucgccggccucaaggugcugccuauuaucaaugaggcuacugccgcagcuauagccuacgggcuugaucgcagaggagcggguaaaaggaacgugcugaucuuugacuugggcgggggaaccuucgaugucagcguucucaguauugacgccggcguguuugaaguaaaggcaacagcuggugauacucaucuugggggagaggacuucgacaaucggcuggugaaccacuuuauggaggaguuccgccgaaagcauggcaaagaucucuccggcaauaagagagccuuaaggcggcugcguaccgcuugcgagcgcgccaaaagaacaccaucuagcuccacccaggcaacgcuugaaaucgacucauuguuugagggggucgauuucuauaagaguauuacuagggcccgguucgaagaacuguguagcgaccuauuucgaucuacacucgagcccguggaaaaagcucugcgcgaugcgaagcuggacaaagcacagauccacgauuucguucugggagguggcuugcacucccauccucagggggccgagguggcugccggacuccugcaaagacagggcgcagaacaggagcaccaaccaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4141 - RNA, 2288 nt, Artificial Sequence
  mRNA product Design3 comprising derived and/or modified sequence from Homo sapiens__NP_006588.1 __HsHSPA8 (opt3)
gggagagucccgcagucggcguccagcggcucugcuuguucgugugugugucguugcaggccuuauucaagcuuaccaugagcaagggccccgccguggggaucgaccugggaaccacauacuccugcgucgguguuuuccagcacggcaaaguggagauuauagcuaacgaucaagggaauagaacuacgccuucuuauguagcauuuaccgacacagaaaggcucaucggagaugccgcgaagaaccagguggcuaugaauccaacuaacaccgucuucgacgccaaacggcuuauuggccgccgauuugaugacgcagugguucagucagauaugaagcauuggccguucaugguggucaaugacgccggucgucccaaagugcagguagaguacaagggggaaacaaagaguuuuuauccugaggaaguuagcuccauggugcugaccaaaaugaaggagaucgcugaggcauacuugggaaaaacugucacaaacgccguggugaccgucccagcuuauuucaaugauucucaaagacaggccacgaaggacgcgggcacuauugcaggcuuaaacguucugaggaucauaaaugaacccaccgccgcugccaucgcauacgggcuagauaaaaaggugggagcugagcggaacguacucauuuuugaccuggguggcgggacauucgaugugucgauccuuacuauugaagacggaaucuuugaggucaagucaaccgccggcgacacacaccuggguggggaggauuucgacaaucgcauggugaaccauuuuauagcggaauuuaaaagaaagcacaaaaaggauauuagcgagaauaaaagggccguucggcgcuugcgaaccgcaugugaaagagcuaagaggacgcucaguuccucuacucaggccagcaucgagauugacucccuguaugaaggaaucgauuuuuacacaucaaucacccgggcucguuucgaggagcugaacgccgaccucuuccgcggcacuuuagauccuguggaaaaagcacugagagacgccaaacuugauaagagucagauucaugacauagucuuggugggcgggagcacaaggaucccaaagauucaaaagcugcuacaggauuucuucaauggaaaagagcucaacaagucuaucaaccccgacgaagcuguagcguacggugcagccguucaggcugccauacuguccggcgacaaaucagagaaugugcaggaucuucuguugcucgacgucaccccucugagcuuagggauugaaacggcaggaggcgugaugaccguccugaucaagcggaacacaacuaucccaaccaagcaaacacagacuuuuaccacauauagugauaaucagccgggugugcucauucaaguuuacgagggggagcgagccaugaccaaagacaacaaucuucugggcaaguucgaauugacuggaaucccucccgcuccacgcggcgugccccagauugagguaacguuugauauagacgccaacgggauccuaaaugucucugcaguggauaaauccacaggaaaggaaaacaaaauuaccaucacuaaugacaaggguagacugagcaaggaggauaucgaaaggaugguucaggaggcggagaaauauaaggcugaagacgagaaacagcgggauaaggugucgucuaaaaacucccucgaaucauacgccuucaauaugaaggcaaccgucgaggacgagaagcugcaaggcaaaauuaacgaugaagacaagcagaaaauacuugacaagugcaaugagaucauuaacuggcuggauaaaaaucagacagccgaaaaggaggaauuugagcaccagcaaaaagaguuggaaaagguguguaacccuaucauuaccaagcucuaucagagugcugggggaaugccaggcgguaugcccgggggcuucccgggaggcggggccccucccagcggaggugcauccucuggcccaacuaucgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4142 - RNA, 2387 nt, Artificial Sequence
  mRNA product Design3 comprising derived and/or modified sequence from Homo sapiens__NP_004125.3 __HsHSPA9 (opt3)
gggagagucccgcagucggcguccagcggcucugcuuguucgugugugugucguugcaggccuuauucaagcuuaccaugaucagcgccuccagagcugcagccgcgaggcuggugggcgcugccgcaucucgggggcccaccgccgcucgccaccaggacucauggaacggacucagucaugaggcauuccgacuugucagccguagagauuacgccuccgaagcuauuaagggugccguugugggcauagaccuggggacaacuaauucuugcguagcggugauggagggaaaacaagcaaaggucuuggaaaacgccgagggcgcuaggacgaccccuucggugguugccuuuacagcagauggugaacgguuaguggggaugccagcuaaacgccaggccgucacuaauccgaacaauaccuucuaugcgacaaagagacugaucggaaggcgguacgacgaucccgaggugcagaaagacauuaagaacguaccuuuuaagaucguucgcgccucaaauggcgaugcauggguggaggcucacggcaaacuauauagcccaagucagauuggggccuucguccucaugaagaugaaagaaaccgcugagaacuaccugggacauacugccaagaaugcagugaucacagugcccgccuauuuuaacgacucccaacgacaggcuaccaaagaugcgggucagauaucuggccuuaauguccugagaguuaucaacgaaccuacggcagccgcuuuggccuacgggcucgacaagagcgaggauaaggugauugcaguauaugaccugggaggcgguacuuucgauaucuccauucuggagauccagaaagggguguuugaagucaagucaaccaauggagacacauuccucggcggcgaggacuuugaucaagccuuacugaggcacauagugaaagaguucaagcgggaaacugggguugaccuuaccaaagauaacauggcuuugcagcgugugcgcgaagccgcagagaaggcgaaaugugagcugaguagcucuguccagacagacauuaaucuaccauaccucaccauggauuccucaggacccaagcaucugaacaugaaguugacgagagcucaguuugaagguaucgugacugaccugauuaggcggacaaucgccccuugccaaaaagcaaugcaggaugccgagguaagcaagagugacaucggcgaaguuauuuuggucgggggaaugacccgaaugccaaaagugcagcaaacugugcaggaucucuucggccgcgcuccgucuaaggccgucaaccccgacgaggcaguggcuauaggugccgcgauccaagggggcguucuggccggagaugugacagacguauuacugcucgacgucaccccucuuucccugggcauugaaacgcuugggggaguguuuaccaaacuaaucaauagaaacacaacuauaccaaccaaaaagagccagguuuucucgacagcugcagauggucagacucagguggagauuaaggucugucagggcgagagggaaauggccggggacaauaagcugcucggacaguucacccugaucggcauucccccugcuccacggggugugccccaaaucgagguaacauuugauaucgacgccaacgggauugugcacguuucugcaaaagauaagggcaccggacgcgaacagcagauagucauccaguccucaggcgggcuuaguaaagacgauauugagaauauggugaagaacgcggaaaaguacgccgaggaggacagaaggaaaaaggaacguguggaggcugucaauauggccgaaggaaucauccacgauacugagacgaaaauggaggaguucaaggaccaacugccggcagaugaaugcaacaaauugaaggaagagauuagcaagaugcgggaacuccuggcucgaaaagacuccgagacaggugagaauauaagacaggccgcaucuagcuuacagcaggccucacugaagcuauuugaaauggcuuauaaaaagauggcgagugagagggaaggcuccgggagcucuggaaccggcgagcaaaaagaagaucagaaggaggagaaacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4143 - RNA, 2375 nt, Artificial Sequence
  mRNA product Design3 comprising derived and/or modified sequence from Homo sapiens__NP_079291.2__HsHSPA12A (opt3)
gggagagucccgcagucggcguccagcggcucugcuuguucgugugugugucguugcaggccuuauucaagcuuaccauggccgacaaggaggcuggcgggagcgauggacccagagaaaccgcaccuacauccgccuacucuucaccagcgaggagucugggugacacuggcaucacgccgcucagccccucccacauugugaacgauaccgacucuaaugucucggagcagcaaucauuccuuguugugguagcuguggauuuugggacaacuagcaguggauaugccuacuccuucaccaaagaaccugagugcauacaugucaugcggcgcugggaaggcggugacccaggggugucuaaccagaagacacccaccacuauccuguugacaccugagcgaaaauuucacagcuucggauaugcagcccgugauuuuuaccaugacuuagauccaaaugaggcuaagcaguggcuguaucuagaaaaauucaagaugaagcuccacaccacgggcgaccugacuauggauaccgaccuuacagcagccaacggcaaaaagguuaaagcucuggagauuuuugccuacgcguugcaguauuucaaggaacaagcacucaaagagcuguccgaucaggccgggucagaguuugaaaauagugacgugagaugggucaucacugugcccgcuauuuggaagcagccugccaagcaguucaugaggcaagcagcuuaccaggccggacuggcgagcccagagaacucugaacagcucaucauagccuuagagccggaagcagcuuccaucuacugucggaaacugcgccuucaucagaugauugaguugucaagcaaggccgcuguaaaugguuauaguggcucugacaccguuggggccggauuuacacaagcaaaagagcacaucagaaggaaccggcagucccgcaccuuccugguggaaaaugucauuggcgagaucuggagcgaacuagaggaaggugauaaguacgugguggucgacuccgggggaggcacgguugaucucacugugcaccagauacgacugcccgagggccaucuuaaagagcuguauaaggccacagggggaccuuacgguucuuugggcguagacuaugaauuugagaaacuccuguacaagauuuucggggaagauuucaucgagcaauuuaagauuaaaagaccagcugcguggguggacuuaaugaucgcauucgaauccaggaagcgggccgcugcccccgaucguaccaacccucugaauaucacucucccauuuucauucauugacuauuacaaaaaguuucgcggacacagugucgagcaugcacuuagaaaaagcaacguggauuucguuaagugguccucucagggcaugcugaggaugagccccgacgccaugaaugcuuuguuuaagccgacaauagauucaaucauugagcaccuacgggaccuguuccagaaaccugaagugaguaccgucaaguuucucuuccugguggguggguuugccgaggcaccccuucugcagcaagcgguacaggcugccuucggcgaccagugccgaaucauaauuccacaggauguuggauugacgauccucaaaggcgcagugcuguuuggguuagacccugccgucaucaaggugcgcagaucgccccugaccuacggagucggugugcuaaacagguauguugaaggcaaacacccacccgagaagcuccuggugaaggaugggacacggugguguacugacguauucgauaaauucauuagcgcugaccaaucugucgcccuuggagaguuggugaagcgcucauacaccccugcaaaaccaagucagcugguuaucgugauuaauauauauagcuccgaacaugauaacgucucuuuuaucacagacccgggcgugaagaaaugcgguacucucagacuggaucuuaccgggacaucgggcaccgcuguacccgccaggcgugagauucagacucugaugcaguucggagacacggaaaucaaggcgacagccaucgauauugcuaccagcaaguccgugaaaguuggcauagacuuuuugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4144 - RNA, 2408 nt, Artificial Sequence
  mRNA product Design3 comprising derived and/or modified sequence from Homo sapiens__NP_443202.3 __HsHSPA12B (opt3)
gggagagucccgcagucggcguccagcggcucugcuuguucgugugugugucguugcaggccuuauucaagcuuaccaugcuggccgugcccgagaugggccuccaggggcuuuacaucggaagcuccccugaaagaucuccagucccgucacccccugguaguccaaggacccaagagagcugcggcauugcuccccugacaccuucccagucuccaaagcccgaaguucgggcaccucagcaggccucguucucagugguaguggcgauagacuuugggacuacgagcaguggauaugcuuucuccuuugccucugauccagaggcaauccacaugaugcgcaaaugggaaggcggugacccgggggucgcccaccaaaagacccccacauguuuguuacugacuccugagggagcuuuccacagcuuuggcuacaccgcacgagauuauuaccaugaccuagauccagaggaagcccgugacuggcucuauuucgagaaauuuaagaugaaaauucacuccgcuacagaucugacccuuaagacucagcuggaagccgugaacggcaagacaaugcccgcguuggagguuuucgcacaugcccucagauuuuucagggagcacgcucugcaggaacugcgggagcagucaccuagucucccagaaaaagacaccgugcgcugggucuuaacggugcccgccaucuggaagcaaccggcaaaacaguuuaugagagaggcugccuaccuggcggggcuuguaagcagggaaaaugccgagcaguugcugauugcacuagagccugaagcugccucuguuuauugccggaagcuccgccugcaccagcuucuggauuuguccggacgagcucccgguggcgggagacucggagagaggcggucaaucgacagcaguuuccgucaagcccgcgaacagcugagaaggucucggcauucccgaaccuuuuuaguggagagcggcgucggugaacugugggcagagaugcaggccggggaucgcuacgugguggcugacuguggaggcggcacugucgaucucacaguucaccaacuugagcagccacaugggacucugaaagaauuguacaaggcgucgggagguccuuauggcgcaguggggguagaccuagccuucgagcagcugcucugcagaauauucggagaagacuuuaucgcuaccuucaagaggcagcggcccgccgcauggguggaucugacaauugccuuugaggcucgcaaaagaaccgccggcccacacagggcgggugcacuuaacaucucucugcccuucuccuuuauugacuucuaccguaagcaacgggggcacaaugucgaaacggcuuugcgaagaucaagugugaacuuuguuaaauggagcucccagggcaugcucaggaugucuugugaggccaugaaugagcuguuccagccuacugugagcggaaucauacagcauauugaagcauuacuggcccgcccagagguccaaggcgugaagcuacucuuucugguagggggauucgcugaaucagccguucuucagcacgcagugcaggcugccuugggugcgcggggccugagagucguggucccgcaugauguggggcucacaauccugaaaggagccguucuuuuuggccaggcucccggugugguaaggguccgccgaaguccucugaccuauggggugggcguuuugaaccgguucgugccaggacgucaucccccugagaagcuccuggucagagacggcaggcgcuggugcacugauguguuugagcgguucguagcagccgaacaauccguggcuuuaggggaggaaguuagaaggagcuacuguccagcccgacccggacagcgccggguccugauuaaucuauauugcugugcagcggaggacgccagauucaucacagauccgggugugaggaaaugcggcgcucucucucuggaacuugagccugccgacugugggcaggauaccgcaggagcuccacccggccgucgcgagauccgggccgcaaugcaguuuggugacacggaaauuaaggugaccgccgucgauguuucaacaaacagaagugugagggcuagcauagacuucuuguccaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4145 - RNA, 1763 nt, Artificial Sequence
  mRNA product Design3 comprising derived and/or modified sequence from Homo sapiens__NP_008879.3__HsHSPA13 (opt3)
gggagagucccgcagucggcguccagcggcucugcuuguucgugugugugucguugcaggccuuauucaagcuuaccauggcccgggagaugaccauccugggcagcgcugugcucacacuucuguuggcaggguacuuagcccagcaauaucugccccuaccuacuccaaaggucauuggaauagaccucgguacgaccuacugcuccguuggcguguucuuuccggggacaggaaaaguaaaggugauccccgaugaaaacggccacauuucuaucccuucaauggucaguuucacugacaaugauguguauguugguuacgagagcguggaacuggcggacuccaacccacagaauaccauuuaugaugcuaaaagguuuaucgggaagauauucacagccgaggaacuugaggcagagaucggacgguaccccuuuaaaguccugaacaagaauggcaugguggaguucucuguaaccucgaacgaaacuauuacaguuucaccugaauaugugggcagccgcuugcuccugaagcugaaagagauggccgaggcuuaccucgggaugccagucgcaaaugccgugaucagugugcccgcugaauuugacuuaaagcagcgaaacuccaccauugaggccgcgaaucuggcaggacuuaaaaucuugcgugucauaaacgaaccuacggccgcugccauggcauacggucugcauaaggcugauguuuuccacgugcuaguaauugaccucggcgggggaacucuggaugugucucuucugaauaaacagggcgguauguuuuugaccagagccaugagcgggaacaauaagcucggaggccaagacuucaaccagaggcuguuacaguaucuguacaagcagaucuaucaaacauacggcuuugucccaucccggaaagaggaaauucaucgccucagacaggcgguggagaugguuaaguugaaucugacuuugcaccagucagcccagcuaagugugcugcucaccgucgaggaacaagauaggaaagagccgcauagcucugacacagaacugcccaaggauaaacuuuccucagcagacgaccaccgggugaacagcggguucggacgcggucugagugauaagaaaucuggcgagucccagguauuguuugaaaccgagaucagccgaaaacucuucgacacgcugaacgaggauuuauuccagaagauccugguuccuauucaacaggugcuaaaggaagggcaccucgagaagacugaaauagacgaggucgugcuggucggaggcucgacaagaaucccaaggauuagacaggugauccaggaauuuuucgguaaagaucccaauaccucuguugacccugaucuugcugugguaacuggggucgccauacaagcuggcauugacggaggcuccuggccacuucaggugucagcccuggagauccccaacaagcaucuccagaaaacaaauuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4146 - RNA, 1877 nt, Artificial Sequence
  mRNA product Design3 comprising derived and/or modified sequence from Homo sapiens__NP_057383.2__HsHSPA14 (opt3)
gggagagucccgcagucggcguccagcggcucugcuuguucgugugugugucguugcaggccuuauucaagcuuaccauggccgcuaucggcgugcaccuggggugcaccagcgcaugugucgccguuuacaaggacgguagagcgggagugguagcuaacgaugccggcgacagggugacacccgcagucguggccuauuccgagaaugaagagauuguugggcucgcugcaaaacagucucggauacgcaacaucucaaauacugugaugaaggucaaacaaauucuuggacgaaguagcuccgauccucaggcccagaaguacaucgcugaaucuaaaugccuggugauugagaagaacggcaaguugcguuaugaaaucgacacgggugaggagaccaaauucguaaauccagaagauguugccagauuaauauuuucgaagaugaaagagacagcgcauucagugcuggggagcgacgcaaacgaugucgugaucacugugccguucgacuuuggagaaaagcagaaaaaugcccuaggcgaggcugccagggcagcuggcuucaacguccuccggcugauucacgagcccagugccgcgcuucuggccuacgggaucggacaagauuccccuaccgguaagucuaauauuuugguuuuuaagcucggcgggacaagccugucccugucagugauggaaguaaacaguggaaucuaucgcgugcucagcaccaauacugacgauaacauaggcggugcacauuucacagagaccuuagcucaguaccuggccucugaauuucagagauccuucaaacacgacgucagggggaaugcucgggccaugaugaagcugacgaacucagcagagguggccaaacauagcuugaguacucugggaucugcuaauuguuuucuagauucccucuaugaaggccaggacuucgacugcaacguuagccgcgcgcgauuugagcugcuuuguucgccacuguucaacaagugcauugaggcaaucagaggcuugcucgaucaaaauggguuuaccgccgacgauauuaacaaagugguccuguguggagguucuuccaggauccccaaguuacagcagcugaucaaagaccucuucccugcuguggaacuucuuaauucaauuccacccgaugagguaauaccuaucggcgccgcaauugaagccgggaucuugauaggaaaggagaaccuacugguugaagacagucucaugauugagugcagcgcucgggauauccuggugaagggcgucgacgaguccggugccucucguuucacagugcuuuuuccaagcgggacuccgcugcccgcacgcagacagcacaccuugcaagcgccuggcucaaucaguuccgucugucucgaacuguacgagagcgauggcaaaaauucugcuaaggaagagacaaaauucgcccaggugguuuuacaggaccuggauaagaaagaaaacggacuaagggacauucucgcagugcugaccaugaagcgggacgggucacuucacguaacgugcacugaucaagagacaggaaagugugaggccaucaguauugaaauagcuagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4147 - RNA, 2924 nt, Artificial Sequence
  mRNA product Design3 comprising derived and/or modified sequence from Homo sapiens__NP_006635.2 __HsHSPH1 (opt3)
gggagagucccgcagucggcguccagcggcucugcuuguucgugugugugucguugcaggccuuauucaagcuuaccaugagcguggucggccuggacguugggucccagucuugcuacaucgccguggcuagagcaggagguauugagaccauagccaacgaguucucagauagguguacacccaguguaaucagcuuuggcuccaagaaucggacuauugggguggcggcuaaaaaccaacagaucacgcacgccaauaacaccgucucuaauuucaagcgcuuucauggacgagcauucaacgacccuuuuauucagaaagagaaggaaaaucucucguaugaucuugugccacugaaaaacggcgguguugggaucaaggugauguacaugggagaggaacacuuguucucagucgagcagauaacagccauguuacugacuaagcuaaaagagaccgcugaaaauagccucaagaaaccggugacagacugcguaaucaguguucccuccuuuuucaccgaugcagagcguagaucugugcuggacgccgcucaaauugucggccuuaacugucugagguugaugaaugauaugacugccguggcgcucaacuauggcaucuacaagcaggaccugccuagccuggaugaaaaaccacggauuguggucuuuguugacauggggcauuccgcauuccaggugucagccugcgcuuuuaauaagggaaagcucaaaguauuagguacagccuucgaucccuuucugggcgggaagaacuucgacgagaaacuuguggagcacuucugugcagaauuuaagaccaaauauaaguuggaugcuaaaaguaagauccgcgcccugcuaagacucuaccaggagugcgaaaagcugaaaaagcugaugagcucuaauuccacggaccuuccuuugaacauagaguguuucaugaacgacaaagaugucucaggaaagaugaauaggagccaauuugaagaacucugcgcggagcuguuacagaaaauugaagugccacuguauagucuccuugagcagacucaucugaagguugaagacgugucugccgucgagaucgugggcggugcaacccggauucccgcuguaaaggaacgcaucgccaaauucuuugggaaggauaucuccacaacuuugaacgcugacgaggccguugcacgaggaugugcccuacagugcgcuauucugagcccugcguucaaagugagagaguuuucggucaccgaugcagugccauucccgauaucucucaucuggaaucacgacuccgaagauacagagggcguccacgaaguguuuucaaggaaccaugccgcucccuucaguaagguucugaccuuucuucggcguggcccuuucgagcuggaagccuuuuacagcgacccacaaggggugcccuacccugaggcaaaaauuggacgcuucguaguccagaauguguccgcccagaaggauggugagaagucuagaguuaaagugaaggucagggugaacacgcacggcaucuucacuauaagcacagcuucaaugguagaaaaagugccaaccgaggaaaaugagaugaguuccgaggccgacauggaauguuugaaccaacggcccccggagaauccugauacugacaagaacguucagcaggacaauagcgaagcagggacacagccccaaguccagaccgaugcgcagcagacgucucaaucaccaccuagucccgagcucaccagcgaagagaacaaaauuccagacgcugauaaggccaaugagaagaaaguggaccagcccccugaagcaaagaaaccaaagaucaaaguggucaacguugagcugccgaucgaagccaauuuaguguggcagcugggaaaggaucuacucaacauguauauugagacagaaggcaaaaugaucaugcaggacaagcuggagaaggagcgaaacgaugcuaaaaaugccguggaagaguacguauaugaauuucgcgacaaacuuugcggucccuacgagaaauucauuugcgaacaagaucaucagaacuuuuugagacugcucacugagaccgaggacuggcuguaugaagagggggaagaucaggcaaagcaggcuuacgucgacaaacuugaggagcugaugaagauaggcacaccugugaagguuagguuccaagaagccgaggaacggccaaaaauguuugaggaauugggacagcgccuccagcacuaugcgaagaucgccgcugauuucagaaauaaagacgagaaguacaaccacauugacgaguccgaaaugaaaaagguggagaagucugucaaugaagugauggaguggaugaacaauguuaugaacgcacaagccaaaaagucgcuggaucaggaccccgugguaagggcucaggaaaucaaaacuaagaucaaagaguuaaauaacaccugugagccugucgugacacagccaaagcccaagauugaaagcccgaaacuggagcguaccccuaauggcccaaacauagauaagaaagaagaggaccuagaagauaagaauaacuuuggggccgagcccccucaucaaaauggagagugcuaccccaacgaaaagaacuccgugaauauggaccucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4148 - RNA, 3347 nt, Artificial Sequence
  mRNA product Design3 comprising derived and/or modified sequence from Homo sapiens__NP_006380.1 __HsHYOU1 (opt3)
gggagagucccgcagucggcguccagcggcucugcuuguucgugugugugucguugcaggccuuauucaagcuuaccauggccgacaaggugagaaggcagcggccccgccgacgugucugcugggcucugguugcagugcuccuugccgaucuguuggcguuaagcgacacccuggcuguaauguccguggaucuaggcucugagucaaugaaagucgccaucgugaagccugggguuccaauggaaauugugcucaacaaagagaguagaaggaagacaccggucauagugacucugaaagaaaaugagcgguucuuuggagacagcgcagccuccauggcuaucaagaaccccaaggcaacgcuucgcuacuuccaacaccuguuggguaaacaggccgauaauccucauguagcucucuaucaggccagauuuccagaacacgagcugaccuucgacccccagaggcaaacaguucauuuucagauuucuucgcagcugcaguucucaccugaggaagugcucggcauggucuuaaacuacagccggagucuggcggaggauuuugcagaacaaccaaucaaggacgccgugauuacugugcccgucuucuuuaaucaggcugagcgccgagccguucuucaggcagcuagaauggccggguugaaagugcugcagcuaaucaacgauaauaccgcgacagcccucuccuauggaguauucaggcggaaggacauaaacaccacugcacaaaauaucauguuuuacgauaugggcucugguagcacaguguguaccauugucacguaucagauggugaaaacuaaggaggcugggaugcagccucaacugcagauccguggaguuggcuucgaccgcacccuuggcgggcuggaaauggaguugagacucagggaacggcuggccggauuauuuaacgagcagcgaaagggucagcgcgcuaaagaugugagagaaaauccaagggccauggcaaagcugcuccgggaggccaaccgccuuaaaacaguccuguccgcuaaugcggaccacauggcacaaauugagggcuugauggacgauguggacuucaaggccaaaguaacuagaguugaguucgaggaacuaugcgcugaucuguuugagagggugccggggcccguccagcaggcccuccagucagcagaaaugagucuggacgagaucgagcaagugauacuugucggaggcgccacccgugugccucggguucaggaagugcuguugaaggcuguagguaaagaggaacucgggaagaacauuaaugccgaugaggcagcggcuaugggagccgucuaccaggcagccgcucugagcaaggccuucaaagugaagccauuuguugugcgagacgcagucguguaucccaucuuaguagaguucacaagagagguggaggaagaaccuggcauucauucucugaaacacaacaagaggguucuauuuucccgcaugggcccauacccccagcggaaagucaucaccuucaacagauacucacacgauuuuaauuuccauaucaacuauggggaccucggauuucuggguccggaagaucuuaggguguucggcagccaaaauuugacgacugugaagcugaagggggucggagacaguuuuaaaaaguacccugauuaugagucuaaaggcauuaaggcucacuucaaccucgacgaguccgguguucugagccuugaccgcguggaaucgguguuugagacacugguagaagauucugccgaggaagaguccaccuugacuaaacucgggaauacaauaucaagucuguucggcggaggcaccacgcccgacgcgaaggagaacgggaccgauacaguccaggaagaggaagagagcccagccgaaggauccaaggacgagccuggugaacagguggaauuaaaagaggaagcugaggcacccguugaagauggcucucagccacccccuccagagccgaagggggacgccacucccgagggagaaaaagcuaccgagaaggaaaauggcgauaaaagcgaggcccaaaagccuucagagaaggcagaagcggguccagaggggguggcccccgcuccugaaggcgagaaaaagcagaaaccagcccgaaagcggcguauggucgaagagaucggaguggagcugguugugcuagaccuccccgaucugccggaagacaaacuugcacagaguguacaaaaguugcaggaucugacacucagagaccuggagaaacaggaaagggagaaggcugccaacuccuuagaagcauucauuuuugagacucaggauaagcuguaccaaccugaguaucaggaagucagcaccgaggaacagcgcgaggaaaucucuggcaaacuuucagccgcuaguacaugguuggaggacgagggggugggagcgaccacugugaugcucaaggaaaaacuggccgagcuacggaagcugugucagggucucuucuuuagagucgaagagaggaaaaaguggccagagcgacugagcgcacuugacaauuugcugaaccauuccucuauguucuuaaagggcgcucgccucauacccgaaauggaucaaauuuuuacggagguugaaaugacaacccuggagaaagugaucaaugaaacuugggccuggaagaacgccacccuugcugagcaggcaaaacugccugccacagagaagcccguauugcucucgaaagacaucgaagcgaagaugauggcucuggaucgggaggugcaguaccuacugaauaaggccaaauucaccaagccaagaccuaggcccaaagacaagaacgggacucgugcagaaccaccgcucaaugccagcgcuuccgaucagggagagaaagucauuccucccgcaggccaaacagaagacgccgagccaaucucagagcccgaaaagguggagacggguagugaaccuggggauaccgagccacuggaacuuggcggacccggcgcggagccugagcagaaggaacagucuacugggcaaaaacgcccguugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4149 - RNA, 2546 nt, Artificial Sequence
  mRNA product Design3 comprising derived and/or modified sequence from Homo sapiens__NP_005339.3 __HsHSP90AA1 (opt3)
gggagagucccgcagucggcguccagcggcucugcuuguucgugugugugucguugcaggccuuauucaagcuuaccaugcccgaggaaacccagacacaagaccagccuauggaggaagaggaaguggagacuuucgccuuucaggcugagaucgcacagcugaugagccucauuauaaacacguucuacuccaauaaggaaaucuuucuuagagagcugauuucuaacucaagugaugccuuggacaaaaucagguaugagagcuuaaccgauccauccaagcuggacucuggcaaagagcuacacauuaaucucaucccgaacaagcaagaucggacacugacuauagucgacaccgggaucggaaugacaaaagcggaucuuauuaauaaccuggguaccaucgcuaagucgggcacuaaggccuucauggaggcauugcaggccggggcugacauuucaaugaucggacaguuuggcguugguuucuacagcgcauaucucguggccgaaaaaguaacagugauaaccaagcauaaugaugacgagcaguacgcuugggaaaguuccgccgggggaucuuuuacgguccgcacugauaccggcgagcccaugggccgagggacaaaagugauucugcaccugaaggaagaccaaacugaguaucucgaggaacguagaaucaaagagauuguuaagaagcauagccaguucaucggauacccuaucaccuuauuuguggaaaaagagagggauaaggaagucuccgacgacgaggcggaggaaaaagaggauaaggaagaggaaaaagagaaggaggaaaaagagucagaagacaagccagagauugaggauguggguagugacgaagaggaagagaagaaagauggcgacaagaaaaagaaaaagaagauaaaagaaaaguauaucgaucaggaggagcugaacaaaacaaagcccauuuggacccggaauccugacgauaucacgaacgaagaguacggggaguucuacaaaagccuuacuaaugacugggaagaucacuuggcaguaaagcauuuuucuguugaaggacagcuggaguuccgcgcccuacucuuugugccaagaagggcucccuucgaccuguucgagaaccggaagaaaaagaauaacauaaaacuuuauguccgccgaguguuuauuauggacaauugcgaagaacugaucccugaauacuugaacuucaucagaggcguggucgauuccgaggaccucccacugaacauuucaagggaaauguuacaacagagcaagauccugaaaguuauucggaagaaucucgugaagaaaugucuugagcuguuuacagaguuggccgaagauaaggagaacuauaaaaaguucuacgaacaguuuaguaaaaauauaaagcuagguauccacgaggacucucaaaaccguaaaaagcuguccgagcuccugcgcuauuacaccagcgcaucgggggaugaaaugguaucucuuaaggacuauugcacuagaaugaaagagaaucagaagcacauuuacuacaucacaggagaaaccaaagaucagguggcuaacuccgccuucgucgagaggcugcggaagcauggcuuggaagugaucuauaugauugagccgauagacgaguacuguguucagcaacucaaagaauuugagggcaagacgcuggugucagucaccaaggaaggguuagagcugcccgaagaugaggaggagaaaaagaaacaggaagaaaagaaaacaaaguucgagaaucuaugcaagaucaugaaagacauucucgaaaagaaaguggagaagguaguugugaguaaccgacuggucacuagcccuuguugcaucgugaccuccacauauggauggacugcgaauauggagcgcauuaugaaagcccaggcacuuagagauaacucuaccauggguuacauggcugccaagaagcacuuggaaaucaauccagaccauagcauaaucgagacacugaggcagaaagcugaagccgauaagaacgacaaaucagucaaggaccucgugauucugcuuuaugagaccgcacuguugaguuccggcuuuagccucgaggauccccaaacucacgccaaucggaucuaccgcaugauuaaacugggguuaggaaucgacgaagaugacccuacggcugaugacacaucugcggcaguuaccgaggaaaugccaccccuggagggcgaugacgauacuucaagaauggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4150 - RNA, 686 nt, Artificial Sequence
  mRNA product Design3 comprising derived and/or modified sequence from Homo sapiens__NG_005218__HsHSP90AA3P (opt3)
gggagagucccgcagucggcguccagcggcucugcuuguucgugugugugucguugcaggccuuauucaagcuuaccauggacagcuccaagcuggauucuggcaaagggcuccacaucaaccuugugcccaauaagcagaaccaaacccugacaauugucgacacuagaauaggaaugacgaaaaccgauuugaucaauaacuuagguacaguuacuaagucaggcaccaaagccuucauggaggcucugcaggcagacgccgauauuaguaugaucgggcauuuuggagugggcuucuacagcgcguaucuaguagcuaagaaggugacagucauuuccaaacacaauaacgacgaacaguacaccugggagucuucggccggugggucauuuacugugaggacagaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4151 - RNA, 2522 nt, Artificial Sequence
  mRNA product Design3 comprising derived and/or modified sequence from Homo sapiens__NP_031381.2__HsHSP90AB1 (opt3)
gggagagucccgcagucggcguccagcggcucugcuuguucgugugugugucguugcaggccuuauucaagcuuaccaugcccgaggaagugcaccauggcgaggaagaggucgaaaccuucgccuuucaggcugagaucgcacaacugaugagccucauuauaaacacauucuacuccaauaaggagaucuuucuuagagaacugauuucuaacgccucagacgcguuggauaaaaucagguaugagaguuuaacugacccuagcaagcuggauuccgggaaagaacuaaagauugacaucauaccaaauccgcaggagcggacgcucacccugguugauacaggaaucgguaugacuaaagcugaccuuauuaacaaucugggcaccaucgccaagucugggacaaaggcauucauggaggccuugcaggcuggagcagauauuucgaugaucggccaguuuggugugggguucuacucagccuaucucguagcugaaaaaguggucgugauaaccaagcacaacgacgaugagcaauacgccugggaaagcagugcgggaggcuccuuuacuguucgcgcagaccauggcgagcccauugggcgaggaacaaaagugauccugcaccugaaggaagaucagaccgaguaucucgaggaacguagagucaaagaggugguaaagaagcauucucaguucauugguuacccuaucacguuauaucuggaaaaagagagggaaaaggagaucagcgacgaugaggccgaagaggaaaaaggcgagaaggaagaggaggacaaagacgaugaagagaagccaaaaauugaagacguuggguccgaugaggaggacgauucaggaaaggacaagaaaaagaaaacuaagaaaauaaaggaaaaguacaucgaucaggaggaacuuaauaaaaccaagcccauuuggacacggaacccugacgauaucacucaagaggaauacggcgaguuuuauaaaaguuugaccaaugacugggaggaucaccuggcugugaagcacuucagcgucgaaggucagcuagaguuucgcgcccuccuguucauaccaagaagggcacccuuugaccuuuucgaaaacaaaaagaagaaaaauaacauuaagcuguacgugcggcgcguguucaucauggacucuugcgaugaguugaucccugaauaucucaauuuuauucgaggggucguugacuccgaggaucugccauuaaacaucucaagagagaugcugcagcagagcaaaauucucaaggugauaaggaaaaauaucguaaagaagugucuugaacuguucagugaguuggcugaagacaaagagaacuacaagaaauuuuaugaagccuucucuaagaaccuaaaacugggcauucaugaggauuccacaaaucggcgucgccucagcgagcugcuuagauaccacaccucgcaaucuggagacgaaaugacgucccugucagaguaugugaguaggaugaaggaaacucagaaaagcaucuacuacaucacaggcgaguccaaggagcaggucgcgaacucugccuuuguggaacggguucgaaagcgcggguucgagguggucuauaugaccgaaccgauugaugaguacugcgugcaacaguugaaagaauuugacggaaagagccucguaucaguuacuaaagagggucuggaguuacccgaagaugaggaagagaagaaaaagauggaagagaguaaggcaaaauucgagaaucuguguaagcuaaugaaagaaauacucgacaagaaaguggagaaggucacaaucuccaacagacuggugagcucuccuugcuguauugucaccucaacguauggcuggaccgcuaauauggaaaggaucaugaaggcccaggcccuucgggauaacaguacaaugggguacaugauggcuaaaaagcauuuggagauuaauccagaccaccccaucguggaaacucugcgccagaaagcagaggccgauaagaacgacaaagcuguuaaggaccucgugguacugcuuuuugagaccgcgcuguugagcuccggauucucucucgaagauccucaaacacacucgaauagaauauauaggaugaucaagcugggcuuagguauugacgaggaugaagucgcagccgaggagccaaacgcugccgugcccgacgaaaucccgccucuggagggggaugaagacgcaagccguauggaggaaguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4152 - RNA, 2759 nt, Artificial Sequence
  mRNA product Design3 comprising derived and/or modified sequence from Homo sapiens__NP_003290.1__HsHSP90B1 (opt3)
gggagagucccgcagucggcguccagcggcucugcuuguucgugugugugucguugcaggccuuauucaagcuuaccaugagagcccugugggugcucggccuuugcuguguccuguugaccuucgggagcguuagggcugacgaugagguggacguagauggaacaguggaagaggacuuagguaagucccgggaaggcucucgcacugaugacgaggucgugcagcgagaagaggaggcaauccaacuggaugggcuaaacgccucacagauucgugaacucagagagaaaagugaaaaguuugcguuccaggcugagguuaauaggaugaugaaacugauaaucaacagccuuuacaagaauaaagagauuuuucugcgggaauugaucuccaacgccucugacgcacucgauaagauucgccugaucucgcugacggacgagaaugcccucucaggaaacgaagaguuaaccgugaagauaaaaugcgauaaggagaaaaaucugcuucacgucacagacacuggcguggguaugaccagagaggaguugguaaagaaccuggggacaaucgcuaaaagcggaaccagugaguuccuaaauaagaugacugaagcacaggaagauggccaauccacaucugagcucauuggccaguuugggguuggauucuauagcgccuuucugguggcugacaaggucaucgugaccuccaaacauaacaaugacacgcagcacauuugggaaucagauaguaacgaguucagcgugaucgccgaccccagggguaauacucuuggccgggggaccacaauaacucuggucuugaaggaggaagcgucugauuaccucgagcuggacaccauuaaaaacuuaguuaagaaauauucccaguuuaucaauuucccuauuuacguguggucaagcaagacagaaaccguagaggaaccaauggaggaggaagaggcagccaaagaagagaaggaggaaagugaugacgaggcugccguggaagaggaagaggaggaaaagaaaccgaagacgaaaaaggucgagaaaacugugugggauugggaacugaugaacgacaucaagcccaucuggcaacgcccuucuaaggagguugaagaggaugaguauaaagcauuuuacaaguccuucagcaaagaaucggacgauccaauggcuuauauucauuuuacagccgagggagaagugaccuucaagucuauacucuucguccccacuuccgcgccucgaggccuuuuugacgaguacgguaguaaaaagucagacuacaucaagcuguaugugagaaggguauucauuacagaugacuuucacgauaugaugccaaaauacuugaacuucguuaaggggguggucgacagcgaugaccuaccccugaaugugucccgggaaacccuccagcagcauaaacugcuuaaggucauccguaaaaagcuggugcgcaagacguuggauaugauuaaaaagauagccgacgauaaauauaacgacaccuuuuggaaggaguucggaacaaauaucaaacucggcguuaucgaggaucacucuaacagaacuaggcuggcaaaguuacugcgguuucagagcucacaccauccuaccgacauuacaagucuagaucaauacguggaacgaaugaaagagaagcaggacaagaucuauuucauggcuggcuccagccgcaaagaagccgagucuucaccauuuguagagagacuccugaagaaaggguacgaagucauuuaucuuacugagccgguggacgaauacuguauacaggcuuugcccgaguucgauggaaagagguuucaaaauguugccaaagaaggugugaaguucgacgagagugagaagaccaaagaaagccgggaggcagucgaaaaggaguuugaaccucugcucaacuggaugaaagauaaggcccugaaagacaagaucgagaaggcugugguaucccagcgccuuacagagucuccaugcgcgcugguggcaucgcaguacggcuggagcgggaauauggaaagaauuaugaaagcccaggcuuaucaaaccggaaaggauaucuccacuaacuacuaugccucacagaaaaagacguucgagaucaaucccaggcacccuuugauucgugacaugcuccggcgaauaaaagaagaugaggacgauaagacaguucuggacuuagcagucgugcuguucgaaaccgccacucuaagaaguggcuaccuccugccagauaccaaggcuuauggugacaggaucgagcgcaugcuucgguugucucugaacauugaucccgacgccaaaguggaggaagaaccggaagaggagccugaagagacagcagaagacaccacugaggauacagaacaggacgaggaugaggaaauggacgucgggacggaugaggaagaggaaaccgcgaaggagagcacugcugagaaagacgaacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4153 - RNA, 2462 nt, Artificial Sequence
  mRNA product Design3 comprising derived and/or modified sequence from Homo sapiens__NP_057376.2__HsTRAP1 (opt3)
gggagagucccgcagucggcguccagcggcucugcuuguucgugugugugucguugcaggccuuauucaagcuuaccauggccagagagcugagggcucuccuucuguggggccggcgcuugcgacccuuacugcgugcuccugcccuagcggcugugccagggggaaagccgauccucugccccagaaggaccacagcccagcuggguccucggcgcaacccagcauggagccuucaagccggcagacuguucuccacucagacggcugaagacaaagaggaacccuugcacucuauuauaucaaguaccgagagcguccagggguccacaucuaagcaugaauuucaggcagagacuaaaaagcuccuggauaucguugccaggucgcuguacucagagaaagaaguguucauucgggagcucaucagcaaugcuagugacgccuuagaaaagcugcgccacaagcuaguauccgauggacaagcguugccugagauggagauucaucugcagaccaacgcagaaaaaggcacaaucaccauacaggacacugguaucgggaugacacaggaggaacuugugucuaaucucggaaccauugcccgaagcggcuccaaggcuuuucuggaugcccuucaaaaccaggcagaggcuucaaguaaaaucauuggccaguucggggucggauuuuauagcgccuucaugguggcggacagaguugaaguguacucuagguccgccgcaccagguucacugggcuaucagugguugagcgaugggaguggagucuuugagaucgcugaggccucuggcgugcggacggguacuaagauaauuauccaccucaaauccgacuguaaggaauuuagcucggaggcucguguacgcgauguugugaccaaguacucuaauuuugucuccuucccccuguauuuaaacgggagaaggaugaauacacugcaagccauuuggaugauggacccuaaagaugugcgggaauggcagcaugaggaauuuuaccgauauguggcacaggcccacgacaagccacgcuacacucuccacuacaaaaccgaugcuccgcuuaacaucagaucaaucuucuauguccccgacaugaagccuaguauguuugacguuagcagggagcugggauccucuguggcguuguacagccggaaaguacuaauucaaacaaaggcaaccgauauacugccaaaauggcuccgcuucaucagaggcguggucgacucagaggauauuccccugaaucuuaguagggaacuguugcaggaguccgcccucauccguaagcugcgggacguguuacagcagcgacugauaaaguucuuuauugaucaaagcaaaaaggacgcugaaaaauaugccaaguucuuugaggauuacggccuauucaugagagaagggaucguuacggcaacugagcaggaggugaaagaagacaucgccaagcuccugagguaugagucuucagcacuuccuaguggacaguugacaagccuguccgaauacgccucucgcaugcgggcagguaccagaaacauuuauuaccucugcgcgccaaauaggcaucuggcugagcacucgcccuacuaugaggccaugaagaaaaaggauacugaaguccuuuucuguuucgagcaguuugacgaacugacauugcuccaucugcgcgaguucgauaaaaagaaauuaaucagcguggaaaccgacauuguaguugaccacuacaaggaggagaaguuugaagaucgauccccggcagccgagugccugucagaaaaagagacggaagaacuaauggcuuggaugcggaacgugcucggcagucgugucaccaaugugaaggucacacugagacuugacacucacccugccauggugaccguuuuggagaugggggcagcuaggcauuuccugcgcaugcaacagcucgccaaaacacaggaggagcgggcgcagcuguuacaacccacucuggaaauaaacccaagacacgcccuuaucaagaaauugaaucagcucagggcuucugagccuggacuggcacagcuacugguggaucagauuuaugaaaacgccaugaucgcugccggccucguagacgauccccgagcaauggucggucgccugaacgagcuuuuggugaaggcgcuggagcggcauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4154 - RNA, 809 nt, Artificial Sequence
  mRNA product Design3 comprising derived and/or modified sequence from Homo sapiens__NP_000609.1__HsIGF1 (opt3)
gggagagucccgcagucggcguccagcggcucugcuuguucgugugugugucguugcaggccuuauucaagcuuaccaugggcaagaucagcucccugcccacccaacucuucaaaugcuguuuuugcgacuuccuuaaggugaaaaugcacacaaugucuucaagucaucuguuuuacuuggccuuaugucugcuaacuuucacgagcuccgcuaccgcagggccugagacacucugcggagccgaacuggucgaugcgcuucaguuuguuuguggugacagaggcuucuauuuuaacaagccaacuggguacggaucuucgucaaggcgggcuccgcagaccggcauuguggaugagugcuguuuccgcagcugcgaccugcgacguuuggaaauguauugugcaccccucaaaccugccaagagugccagauccguaagggcucagcggcacacagauaugccaaagacccagaaagaggugcaucugaagaaugcaucucgcgguagcgccgggaacaaaaauuacagaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4155 - RNA, 890 nt, Artificial Sequence
  mRNA product Design3 comprising derived and/or modified sequence from Homo sapiens__NP_000603.1__HsIGF2 (opt3)
gggagagucccgcagucggcguccagcggcucugcuuguucgugugugugucguugcaggccuuauucaagcuuaccaugggcauccccaugggaaagagcaugcuggugcuccuuaccuuccuggccuuugcuuccugcuguauugcagccuacagaccuucugagacauugugcgggggugaauuagucgacacucugcaguucguuuguggcgauaggggguuuuauuucucacggccagcgagucgcgugagccgacguuccagaggaauaguagaggaaugcuguuuuaggucuugcgaccuagcucuccuggagacguacugugccaccccggcaaaaucggaacgggaugugucaacacccccuacuguccuuccagacaacuucccccgcuauccugugggcaaguuuuuccaauacgauaccuggaaacagagcacacagagacugaggcgggguuugccagcccuccugcgcgcucgaagagggcacguucuggcaaaggagcucgaggccuuuagggaagcuaaacggcaucgucccuuaaucgcccugccuacccaggacccagcgcacggaggcgcaccgcccgagauggccaguaaucgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4156 - RNA, 986 nt, Artificial Sequence
  mRNA product Design3 comprising derived and/or modified sequence from Homo sapiens__NP_000591.1__HsIL6 (opt3)
gggagagucccgcagucggcguccagcggcucugcuuguucgugugugugucguugcaggccuuauucaagcuuaccaugaacagcuucuccaccucugccuuuggccccguggcuuucucacuggggcuccuucuggucuugccugcagccuuuccagcgccgguucccccuggagaggacaguaaggauguggcugccccacacagacagcccuuaacaagcuccgaaaggaucgacaaacaaauucgguacauacuggaugguaucucugcacuacgcaaggagacuugcaauaaaucgaacaugugugaaucaagcaaggaggcccucgcugaaaauaaccugaaucuuccuaaaauggcagagaaggacggcugcuuccagaguggguuuaacgaggaaacgugucugguaaagauuaucaccggauugcucgaguucgaaguguaucuggaguaccugcagaaucgauuugaguccucugaagaacaggcccgugcuguccaaaugagcacaaaagugcucauucaguucuuacagaagaaagccaagaaccuggaugcgaucacuaccccagaccccacaaccaaugcaucccuuuugacuaaacugcaggcccaaaaccaguggcuacaggauaugacaacccaucucauacugagaucauuuaaggaguuccuucagaguagccugagggcuuugcggcaaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4157 - RNA, 1628 nt, Artificial Sequence
  mRNA product Design3 comprising derived and/or modified sequence from Homo sapiens__NP_002183.1__HsINHBA (opt3)
gggagagucccgcagucggcguccagcggcucugcuuguucgugugugugucguugcaggccuuauucaagcuuaccaugccccugcucuggcuuagaggcuuccuguuggccagcugcuggaucauugugagguccucuccuaccccagggucagagggacacagugcugcaccggacugucccagcugcgccuuagcggcucugccuaaggaugucccaaacucccagcccgaaaugguugaggccgugaaaaagcauauacuaaauaugcuccaccugaaaaagcggccugacguaacacaaccagugcccaaagcagcccuucugaacgcuauccgcaaguugcaugucgguaaggugggcgaaaauggguacguugagauugaagaugacaucggacgacgugcagagaugaacgagcucauggaacagacuucugagauuaucacguuugccgaaucgggcaccgcuagaaaaacacugcacuucgagauaucaaaggaggguagcgaucugaguguggucgaaagggccgagguguggcucuuuuuaaaaguaccuaaggcgaaucggacucgcaccaaaguuacaaucagacuguuccagcagcaaaagcauccacaggggucccuugacaccggagaagaggcagaagaggugggcuugaagggcgagaggucugaacugcuacucagcgagaaagucguggaugcccggaaguccacuuggcacguguuuccggucucaaguagcauucagcgccugcuugaccaggggaaaucuucccuggauguucgaaucgcuugugaacaaugccaggagucaggagccagcuuggugcuccuggguaagaaaaagaaaaaggaagaggagggcgaagggaagaaaaagggaggcggugaagggggagcaggcgcugacgaggagaaagaacagagucacagacccuucuuaaugcugcaggccaggcaaucugaggaucauccucaccggcgucgcagaaggggccucgagugugacgggaagguaaacauuugcuguaaaaagcaguuuuucguguccuuuaaggauaucggauggaaugacuggauaauugcgccaagcgguuaucaugccaacuacugcgaaggcgagugucccucgcacaucgcagggacaucuggauccucacuuaguuuccacagcaccgucauuaaucauuaucggaugcgaggccacuccccuuuugcuaaccugaaaucuugcugugugccaacgaaguugcgccccaugagcaugcuauacuaugacgauggucagaauaucaucaaaaaggacauucaaaacaugauaguugaagagugcgggugcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4158 - RNA, 1571 nt, Artificial Sequence
  mRNA product Design3 comprising derived and/or modified sequence from Homo sapiens__NP_002184.2__HsINHBB (opt3)
gggagagucccgcagucggcguccagcggcucugcuuguucgugugugugucguugcaggccuuauucaagcuuaccauggacggccugcccgggagagcccucggagcugcaugccuucuguuguuagccgcggguuggcugggcccugaggcuugggggagcccaaccccgcccccuacaccagccgcacccccuccacccccuccaccgggaucccccggcgguucucaggauacuuguacgucaugcgggggauucaggcggccugaggaacuaggccgcguggacggcgauuuucucgaagccgucaagcgacacauccugagucgucuucaaaugagagggaggccaaacauuacccaugcuguucccaaagcagccauggugacagcucugcggaaguugcacgccggaaaaguacgcgaggacgguagaguggaaauaccucaucucgauggccacgcgagcccaggggcagacggacaggagagggucuccgagaucauuucuuucgccgaaacugauggccuggcuucgucacgggugcgccuguacuuuuucaucagcaaugaggguaaccagaaucucuuuguugugcaggccaguuuauggcuguaucuuaaguugcugcccuacguccuagaaaaagggucccgaagaaaggugaggguaaagguuuauuuccaagagcagggacauggcgaccgguggaacaugguggagaaacgugucgaucucaagcgcucuggcuggcacaccuuuccgcugacagaagcaauucaggcucuuuucgagagaggggaaaggcggcugaauuuggacgugcagugugauagcugccaagagcucgccguggucccuguuuuuguggaccccggagaagagucccaccgaccauucguagugguccaggcgcgccugggugauucaagacauaggauccggaaacgcggcuuagagugugacgggagaaccaaccugugcuguaggcagcaguuuuucauagacuuucgucucaucggauggaaugauuggauuaucgccccuacuggcuacuaugguaacuacugcgaagggaguugucccgcauaucuugcuggcgugccaggaagcgccucuuccuuccacacagcuguugugaaucaauaccggaugcgaggccugaaccccgggaccgucaauucaugcuguauuccuacgaaguugagcacuaugaguaugcuauacuucgacgaugaguauaacaucgugaaaagagacguaccaaauaugauaguugaagagugcggaugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4159 - RNA, 3806 nt, Artificial Sequence
  mRNA product Design3 comprising derived and/or modified sequence from Homo sapiens__NP_000623.2__HsITGAM (opt3)
gggagagucccgcagucggcguccagcggcucugcuuguucgugugugugucguugcaggccuuauucaagcuuaccauggcccugagagugcuccuucugaccgcuuugacauuaugccacggcuucaaccuggacacugagaaugcaaugacguuucaggaaaacgccaggggguucggacaaagcgucguucagcuacaggguucccgggugguagugggcgcgccccaggagaucgucgcugccaaucaacgcgggucucucuaccagugugauuauucaaccggaaguugcgaaccuauucgacugcaagugccaguugaggcagugaacaugagccuuggccuguccuuggccgcuacaacuucuccgccccagcuccuggcaugugguccuaccguccaucaaacaugcucggaaaauaccuacgugaaggggcuguguuuucucuucggaucaaacuuacgucagcagccacagaaauuucccgaggcccugagaggcugcccucaagaggacagcgauauagcuuuccuuaucgacggcaguggguccauuaucccacacgauuuuaggcggaugaaggaguucguaucuacuguuauggaacaguugaaaaagagcaaaacacuguuuucccuaaugcaguauucagaagaguuccgcauucauuuuaccuucaaggaguuucaaaauaaccccaauccuagaagucucgugaagccaaucacgcagcugcuuggaaggacucacaccgccacagguauacggaaagucgugcgcgaacuguucaacaucacuaauggcgcgcgaaagaacgcauucaaaauuuugguggucaucaccgacggggagaaguuuggagauccgcucggcuacgaagacguuauucccgaggccgauagagaaggugugaucagguauguaauaggggugggagacgcuuuccggagcgagaaaucucgucaggagcugaauacaauugccuccaagccuccacgcgaucaugucuuucaggugaacaauuucgaagcauuaaagaccauccaaaaccagcugagagagaaaauuuuugcuaucgaaggcacgcagacuggcucaagcaguucuuucgagcacgaaaugucccaggagggguuuagcgccgcgaucacaucgaacggaccccuccuuucuaccguugguuccuacgacugggccggcgggguguuccuguauacuucaaaggagaaaaguacauuuauuaauaugaccagggucgauagcgacaugaacgacgcauacuugggauacgcugccgcuauaauccuacggaaucgagugcaaucccugguacucggcgccccucgcuaucagcacauuggucugguugcaauguucagacagaacacggggaugugggaaucuaaugccaacgugaagggcacccagaucggagcuuacuuuggcgcgagccuuuguucagucgauguggacaguaauggguccacagaucuggucuugauaggagcaccacauuauuacgagcaaacuagggguggccaggugagcguuugcccccucccgcgggggcgcgccagauggcagugugacgcugugcuguauggagaacagggccaaccuugggguagguucggggccgcauuaaccguacugggcgaugucaacggagacaaacuaacagauguggccauuggcgcucccggggaggaagacaaucguggagccguuuaccucuuucacgguacuucuggcucagggaucaguccaagccauucccagcggaucgcaggaucuaagcugucgccucgacuucaguauuucggccagagcuuguccggugggcaggaucugaccauggacggccucguggaucugacagucggagcgcagggccacgugcuucuguugagaucacagcccguacucagggugaaagcuauuauggaguucaacccacgcgagguugcccggaaugucuuugaaugcaacgaccaaguggugaaggggaaggaggcaggagaagucagaguuugucugcacgugcagaaaaguaccagggaccgcuuacgagagggccagauccagucugugguaacuuacgaucuggcccuagacagcggucggccccauucccgugcugucuucaaugagacgaagaacucaacaagaaggcaaacccaggugcucgggcugacucagaccugcgaaacacuuaaauugcagcugccuaauugcauugaggauccaguuagcccgauagugcuccgccugaacuuuucuuuagucggaaccccucuguccgccuucggcaaccuucggccuguguuggcagaagacgcucaaagacucuuuacugcccuguucccauuugagaagaauugugguaacgauaauaucugccaggacgaucuaaguauuacauucagcuuuaugucucuggacugucucguugugggcgggcccagggaguucaacguaacggucaccgugcgaaaugauggagaagacuccuaccgcacucaggugacauuuuucuuuccucuggaucuuucauaucggaaagucaguaccuugcaaaaccagagaagccagaggucguggcgucuggcgugcgaguccgccucuagcacagaaguuucaggcgcuuuaaagaguacuuccuguucuaucaaucacccaaucuuccccgagaacagcgaagugaccuucaauauuacguuugacguagauuccaaggcaucacucgggaacaaacugcuucugaaggccaaugugaccagcgagaacaauaugccgcgcacaaacaaaacugaguuccaguuggaacucccugucaaguacgcuguguauaugguugugaccagucauggagucucuacaaaauaccugaauuuuacugccuccgagaacaccagccgggugaugcaacaccaguaucagguuucgaaccuaggccagagaucacugccaauaucucucguguuccugguccccguaaggcuuaaucaaacggugaucugggaccgaccucagguuacauuuagugaaaacuuguccucuaccugccauacuaaggagcggcugcccagccacagcgacuucuuagcagaacuccgcaaggcgccaguggucaauuguuccauugccgugugccagagaauccagugugauauucccuuuuucgguauccaagaggaauuuaacgcuacacugaaagggaaucuuucauucgacugguacauaaagaccagucacaaccaucugcuaaucguaagcacugccgagauucucuuuaaugauucuguguucacccuguugcccggacagggcgcauucgucaggucccagacagagacgaaaguugaaccauuugaggugccgaacccucugcccuuaaucguggguucaagugucggcgggcuccugcuucuggcuuugauuaccgccgcacucuauaagcugggauucuuuaaacggcaguacaaggacaugaugagcgaaggcgggccacccggagccgagccucaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4160 - RNA, 1751 nt, Artificial Sequence
  mRNA product Design3 comprising derived and/or modified sequence from Homo sapiens__NP_002415.1__HsMMP8 (opt3)
gggagagucccgcagucggcguccagcggcucugcuuguucgugugugugucguugcaggccuuauucaagcuuaccauguucagccugaagacccuccccuuucuucuguuguuacacgugcagaucuccaaagccuucccugucucuucaaaggagaaaaacacaaagacuguucaagacuaccuggaaaaauuuuaucagcuaccaaguaaucaguaccagagcacgagaaagaacggcaccaaugugauuguagagaagcucaaagaaaugcaaagguucuuugggcugaacgugacaggaaagccgaaugaggaaacucuugauaugaugaaaaagccccggugcggugucccugacuccggcggguucaugcugaccccaggaaaccccaaaugggagcgcacaaauuugaccuaucgaauacguaacuacacuccucagcucucugaggcugaaguggagagagcaaucaaggaugccuuugaacuguggucgguugcgucaccacugauuuucacaaggaucagccagggcgaggcugacauuaauaucgccuuuuaucagcgggaucauggugacaacagucccuucgaugggccuaauggaauacucgcacacgccuuucaaccaggccagggcaucgggggagacgcucauuucgaugcagaggaaaccuggacgaacacuuccgccaauuacaacuuauuucugguggcugcccacgaguucggucauucucuuggcuuggcgcacagcuccgacccgggggcacugauguaucccaauuacgccuuccgcgaaaccucaaacuacagucuaccucaggaugacauugauggaauccaggcuauuuauggccucagcucuaacccaauccaacccacagguccuuccacuccaaagcccugugacccgucacugaccuuugacgccauaacaacccuuagaggggagauucuguucuuuaaagauagguacuucuggcggcgccacccucaguugcagcgagucgaaaugaauuuuaucagccucuucuggcccagucugccaacgggcauucaagcagcuuaugaggacuuugauagagacuuaaucuuccuguuuaagggaaaccaguacugggcccucucuggcuaugauauccuucagggguacccuaaagacauuuccaauuauggauuccccagcucggugcaggcgauagaugccgcaguauuuuacaggucuaagacuuacuucuuuguuaacgaccaauucuggcgguaugauaaucagcgucaguucauggagccagguuaccccaaauccaucucaggcgcuuuuccugggauugaaaguaagguggacgccgucuuccagcaagagcacuuuuuccauguguuuagcggaccacgcuauuacgcuuucgaucugaucgcccagagagugacaagggucgcacggggcaacaaaugguugaauugccgauaugguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4161 - RNA, 2471 nt, Artificial Sequence
  mRNA product Design3 comprising derived and/or modified sequence from Homo sapiens__NP_004985.2__HsMMP9 (opt3)
gggagagucccgcagucggcguccagcggcucugcuuguucgugugugugucguugcaggccuuauucaagcuuaccaugagccuguggcagccccucgugcuuguccuguugguuuuaggcugcuguuucgccgcuccuagacaaaggcaguccacccuggugcuauuuccaggggaccuccggacaaaccugacugaucgccagcuugcagaggaauaccuguaucgauacggauauacgcguguagccgagaugagaggugaaucuaaaucauugggcccggcgcuccugcugcuccagaaacaauuaagucugcccgagaccggggaacuugacagcgcuacauugaaggccaugaggacuccucggugcggagugccagaucugggccgcuuccagaccuuugagggugaccuaaaauggcaccaucacaauaucacauacuggauucagaacuauuccgaggaucuccccagagcagucauagacgaugccuucgcuagggcauuugcccuguggucugcugugaccccucuuacuuucacacggguuuacucgcgcgacgccgauaucgugauucaguuuggggucgcggaacauggagacggcuauccauucgauggcaaggacgggcuguuggcacacgccuuucccccuggaccagguauccaaggcgaugcucauuucgacgacgaugagcucuggucacuggggaaaggagugguaguuccgacccgauuuggcaaugccgacggugcagcuugucacuuccccuuuauuuucgaagggagaagcuacagugccugcacgacugauggaagguccgacggcuuaccuugguguucuaccacagcgaacuacgauacugacgaucgguucggcuuuugcccaagcgagcgucuguauacccaggacgggaaugccgauggaaagcccugucaguucccuuuuaucuuccagggucaauccuacucagcaugcacaaccgacggccgcagugauggguauagauggugugcuacgacugccaacuacgacagggacaagcucuuuggauucugcccaacacgggcugauagcaccgugaugggcgguaauucugccggggagcuuugugucuuucccuucacuuuucugggcaaagaauauuccacaugcaccucagagggacgaggcgacgggcgcuuguggugcgcaacgaccagcaacuucgauagugacaagaaauggggauuuuguccggaucaggguuacucucuauuccugguggccgcucacgaauuuggccaugcgcucgggcuggaccacuccagcgugccugaggcacuuauguaucccauguacagauucacagaaggaccaccucugcauaaggaugacgucaauggcauaaggcacuuguacgguccccggccagagcccgagccucgcccaccgacuaccacaacuccccagccuaccgccccacccacaguuugcccuaccgggccacccacugugcacccgucggaaagaccuacggcuggcccaacaggacccccuucugccggccccaccgggccaccuacugcaggacccuccaccgccacaaccguaccacucucaccgguggaugacgcuuguaacgucaauaucuucgaugccauugcagagaucgguaaccaacuguauuuauuuaaagacggcaaguacuggagguucagugaagggcguggaagccggccucagggccccuuucugauugcggauaaguggccagcucuaccccgaaaacucgacuccguguucgaggaaagacugucuaagaaauuguuuuucuuuagcgguaggcagguuuggguguauacuggggccucaguccuuggcccucgccggcuggacaagcucggacugggcgcagauguggcccagguaacaggggcucuuagaaguggaaggggcaaaaugcuguuguucuccggucgccgacucuggcgguuugacguuaaggcccaaaugguggauccacguagcgcaucugaggucgacagaauguuccccggggugccucuggauacgcaugacgucuuucaguacagggagaaggcuuauuucugccaggaucgcuuuuacuggcgggugucaaguagaagcgaauuaaaucagguugaccaagugggauauguaaccuacgauauccugcaguguccggaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4162 - RNA, 1763 nt, Artificial Sequence
  mRNA product Design3 comprising derived and/or modified sequence from Homo sapiens__NP_002418.1__HsMMP13 (opt3)
gggagagucccgcagucggcguccagcggcucugcuuguucgugugugugucguugcaggccuuauucaagcuuaccaugcaccccggcgugcuggccgcuuuccucuuucuuagcuggacccauugcagagcacugccuuugccauccgggggagacgaggaugacuuaucugaagaggaucugcaguucgccgaaagguaccuacggucauauuaccacccgacaaaccucgcggguauccugaaggagaaugcugccaguagcaugacugaacgccuucgagagaugcaauccuuuuucggccuggaggucacggggaaauuggacgauaacacccucgacguuaugaagaaaccccguuguggagugccugauguaggcgaauauaauguguuuccaagaacacugaaguggucuaaaaugaaccugacuuacaggauugucaauuauacccccgacaugacacauucggagguggaaaaggcauucaagaaagccuuuaagguuuggucagaugugaccccucucaacuucacucgguuacacgacgguauagcugauaucaugauuagcuuugggaucaaagagcauggagacuucuacccauuugauggccccaguggccugcuugcacacgccuucccuccagggccgaauuauggaggugacgcucacuuugacgaugacgagacauggaccuccucuagcaagggcuacaacuuguuccuggucgccgcgcaugaguucgggcacucccuaggacucgaucauucaaaagaccccggcgcacugauguuuccuauuuacacguauacugguaagagucacuucaugcuuccagaugacgaugugcaggggauccagagccuguacggacccggcgacgaagauccuaauccaaagcaccccaaaaccccggacaagugcgauccuucuuugucccucgacgccauaacaucacugcgcggcgaaacuaugaucuuuaaagacagauucuuuuggagguuacauccccagcaaguagaugcugagcuguuccucaccaagagcuuuuggccagaacuuccuaaccggauugacgccgcauaugagcaccccagucaugaucugaucuucauuuuucgcgggcgaaaauucugggcuuugaauggauacgacauccuagaggguuauccaaagaaaauaucugaacugggccuccccaaggagguuaagaaaauuuccgccgcggugcacuuugaagauacagggaagacccugcuuuucagcggaaaccaggucuggagauacgacgauacgaaucauaucauggacaaagauuauccuaggcugauugaggaagacuuuccaggcaucggugauaagguggacgccguguacgagaaaaacggguacaucuauuucuucaauggcccgauucaguuugaguacucgauauggucuaaccggaucguccguguuaugcccgcaaacuccauuuugugguguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4163 - RNA, 1415 nt, Artificial Sequence
  mRNA product Design3 comprising derived and/or modified sequence from Homo sapiens__NP_001286.1__HsCCR1 (opt3)
gggagagucccgcagucggcguccagcggcucugcuuguucgugugugugucguugcaggccuuauucaagcuuaccauggagacccccaacacaacugaagacuacgauacgaccacagaguucgacuauggcgaugccacuccuugccagaaggugaaugaaagagcuuuuggggcacaacugcucccaccgcuuuacagccuggucuucguuaucggauugguggguaacauuuuaguagugcugguccuagugcaguauaaaaggcucaagaauaugaccuccauauaccugcuuaaccuggccaucucugacuugcucuuucuguucacacugcccuuuuggauugauuauaaacucaaggacgauuggguuuucggcgacgcgauguguaaaaucuuaucaggguuuuacuauaccggacuguacagugagauuuucuuuaucauacuuuugacuaucgaucgguaccuggcuauugugcacgccgucuucgcacuacgcgcccgaacagugaccuuuggcguaaucacgagcauuaucauaugggcucucgcaauucuggccuccaugccuggucuuuauuucucuaagacucagugggaauuuacccaucacacaugcucgcugcauuucccacacgagucauugcgugaguggaaacucuuccaggcucugaaguuaaaucuguuugggcucguucuuccccuguuggugaugaucauuuguuacacuggaaucaucaagauucuacugagaaggccuaacgagaaaaagagcaaagccguccggcucauauucgugaucaugauuaucuuuuuccuguuuuggaccccauauaaucuuacaauacugauuaguguguuccaagacuuuuuguucacccaugaaugcgaacagucccgccaccucgaucuggcgguccagguuacggaggugaucgcauacacucacuguugcguaaaccccgugaucuaugccuuugucggcgagagauucaggaaguacuuacggcagcuguuucaucgccgaguggcuguucaccuagugaaguggcucccuuuccugucugucgacagacuugaaagggugagcuccacaucaccaaguaccggcgagcaugaauugagcgccggguuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4164 - RNA, 983 nt, Artificial Sequence
  mRNA product Design3 comprising derived and/or modified sequence from Homo sapiens__NP_002598.4__HsPDGFA (opt3)
gggagagucccgcagucggcguccagcggcucugcuuguucgugugugugucguugcaggccuuauucaagcuuaccaugagaacccuggccugccuccuucuguugggauguggguacuuagcucacgugcuggcagaggaagccgagauccccagggaagucauugagcggcuagcgcgcagccagauacauuccauccgagaccuccaacgucugcuugaaauugauucuguuggaucagaggacagucuggauacuagcuugagagcucacggugugcaugccacaaagcacguaccugagaaaaggccacucccgauccggcgcaagagauccauugaagaggcagugcccgccgucugcaaaacgaggaccgugaucuaugaaauaccucggucucagguugacccaacaucggcuaacuuccugaucuggcccccuuguguggaggucaagcgcugcacuggcuguugcaauaccucaagcgugaaaugucagccaagucgaguacaucacagauccguuaagguggcaaaggucgaguacgugaggaaaaagcccaaacugaaggaagugcagguccggcucgaggaacacuuagagugcgccugugcuacaaccucucugaacccugauuaucgugaagaggacacugggcgcccaagagagagcggcaaaaagaggaagcggaaacgacuuaagccgacaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4165 - RNA, 1073 nt, Artificial Sequence
  mRNA product Design3 comprising derived and/or modified sequence from Homo sapiens__NP_002599.1__HsPDGFB (opt3)
gggagagucccgcagucggcguccagcggcucugcuuguucgugugugugucguugcaggccuuauucaagcuuaccaugaacagaugcugggcccuguuccucagccuuuguugcuaccugagguugguguccgcugagggcgaccccaucccugaagaguuauaugaaaugcugucugaucacucaauucggaguuuugacgaucuacagcgccuccugcauggggacccaggagaggaagauggugcagagcuugaccugaauaugacccgaagccacuccggcggggaguuggaaucucucgcccguggaagaaggucgcugggcucacugacaauagcggagccggcuaugaucgccgaauguaagacucggacggaggucuucgagauuagccgcagacucaucgauaggaccaacgcaaacuuuuuaguuuggcccccuugcguggaaguacaacgguguagugguugcuguaauaaucgcaacgugcagugccgaccaacacagguccagcugagacccgugcaaguuaggaaaauugagaucgugcggaagaaaccuauauucaagaaagccacugucacccuugaagaccauuuggcuuguaagugcgagacaguggcagccgcucguccaguaacccgcucccccgggggaucucaggaacagagagccaagacuccucagacaaggguuaccauccggacggugcgaguccgcagaccaccgaaaggcaagcacaggaaauuuaagcauacucacgauaaaaccgcgcugaaggagacacuaggcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4166 - RNA, 1385 nt, Artificial Sequence
  mRNA product Design3 comprising derived and/or modified sequence from Homo sapiens__NP_057289.1__HsPDGFC (opt3)
gggagagucccgcagucggcguccagcggcucugcuuguucgugugugugucguugcaggccuuauucaagcuuaccaugagccuguucggccuccuucuguugaccuccgccuuagcugggcagagacaaggaacacaggcagagucuaaccugucaaguaaguuucaguucagcuccaauaaagaacagaacggugugcaagacccccagcacgagaggaucauuacugucucuacgaauggcucgauacauucaccucgguuuccacacaccuacccgcgcaacacaguucuaguguggcgacucguagccguggaagagaaugucuggauccagcugacuuucgaugaacguuuugggcuugaggaccccgaggaugacauuugcaaguaugauuucguggaaguugaggaaccuagcgacggaaccauccugggcagauggugugguagugggacagugccaggaaaacagauuuccaagggcaaccaaaucaggauacgguuugucucugaugaguacuuccccagcgagccuggcuuuugcauccauuauaauauugugaugccacaguucaccgaagcgguaucccccucaguuuugccuccaagugcucucccgcuggaccugcucaacaaugccaucacugcauuuagcacauuagaggaucugauucgcuaccuugaacccgagagauggcaguuggaccuggaagaucuauauaggccuaccuggcagcuccuggggaaagccuucguguuuggacggaagucucgcgucguggaccuuaaccuguugacggaggaggugcgacucuacuccuguacuccaagaaauuucucagucagcaucagggaggaacugaagcggaccgauacaauauucuggcccgguugcuuacugguuaaacguuguggcgggaacugcgcuuguugccuccacaauuguaacgaaugccaaugugugccuaguaagguaacuaaaaaguaucaugaggugcuucagcugcgcccaaaaaccggagucagaggcuugcacaagucucuaacagacguggcacuggaacaccaugaggagugcgacugcguuuguagggguuccaccgggggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4167 - RNA, 1442 nt, Artificial Sequence
  mRNA product Design3 comprising derived and/or modified sequence from Homo sapiens__NP_149126.1__HsPDGFD (opt3)
gggagagucccgcagucggcguccagcggcucugcuuguucgugugugugucguugcaggccuuauucaagcuuaccaugcacagacugaucuucguguacacccucauuugcgccaacuuuuguagcugcagggacacauccgcuacuccccagucugcaucaauaaaggcccuucggaaugcgaaccugcgccgagaugacuuguaucguagagaugagacgauccaagucaaaggaaauggguacguucagaguccuagguucccaaacagcuauccgcggaauuuacugcuaaccuggcgccuccauucccaggaaaacacaaggauucagcugguguuugacaaucaauucggacuugaggaagcugagaacgauaucuguagauacgacuuuguagaaguggaggauauuucugagacuucgaccaucauacggggucgcuggugcggccacaaggaagugcccccucgaaucaaaucaagaacaaaucagauuaagaucaccuucaaaagcgacgauuauuuugucgccaagccaggguucaagauuuacuauagucuguuggaggacuuucagcccgcagccgcuuccgaaacuaacugggagucuguuacaagcuccaucucaggagugaguuacaauagcccuucugucaccgauccaacgcucauagcagacgcccuggauaaaaagauugcugaguucgacacuguggaagaccugcucaaauacuuuaaccccgaguccuggcaggaagauuuagagaauauguaucuggacaccccuagguaccggggccguucauaucaugaucgcaagagcaaaguagaccuugauagauugaacgacgaugccaagagguacaguuguacaccacggaauuauucuguuaacauccgagaggaacugaagcuagcgaacguggucuucuuuccgcgcugccuccuggugcaaagauguggugggaauugcggauguggcacugugaacuggagguccugcaccuguaauagcggcaaaacagucaagaaauaccacgagguucuucaguucgaacccgggcauauuaagcggcgcggcagagcaaaaaccauggcccugguggacauccaguuggaucaccacgagaggugcgacugcaucuguucgucucguccuccacggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4168 - RNA, 1025 nt, Artificial Sequence
  mRNA product Design3 comprising derived and/or modified sequence from Homo sapiens__NP_003946.3__HsSOCS3 (opt3)
gggagagucccgcagucggcguccagcggcucugcuuguucgugugugugucguugcaggccuuauucaagcuuaccauggugacccacagcaaguuccccgccgcuggcauguccagaccucuggacacaucucucaggcuuaaaacuuuuucaaguaagagcgaguaccagcuggucguuaacgcagugcggaaauugcaagaauccggguucuauuggucugccguaacgggaggugaggcgaauuuacugcuaucggcugaaccagccggcaccuuucucauccgcgauucaagcgaccagcgacauuucuuuacacugagugugaagacucaguccgggaccaaaaaccuucguauucagugcgagggaggcucuuucagccugcaauccgauccgagaucaacacagcccgucccuagguuugacuguguguugaagcucguucaccauuacaugccacccccuggugcaccaaguuuccccagcccuccaaccgaaccgucuuccgaggugcccgagcagccuucagcccagccacugcccgggagcccuccacggcgcgcuuauuacauauauaguggaggcgaaaagaucccccugguccucucuagaccguuauccagcaauguggcaacucugcaacaccuuugcaggaaaacaguaaacggccauuuggauucguacgagaagguuacccagcugccugggcccauucgggaauuucuagaccaguaugaugccccacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4169 - RNA, 830 nt, Artificial Sequence
  mRNA product Design3 comprising derived and/or modified sequence from Homo sapiens__NP_003227.1__HsTGFA (opt3)
gggagagucccgcagucggcguccagcggcucugcuuguucgugugugugucguugcaggccuuauucaagcuuaccauggugcccagcgccggccagcuggcucucuucgcacuugggaucguccuggccgcgugccaggcuuuggagaacuccaccucuccuuuaucagccgacccaccgguugcagccgcugugguaagucacuuuaaugauugucccgacagccauacacaauucugcuuucacggaacuuguagauuccuggugcaggaagauaagccugcaugcgucugucauuccgguuacgugggcgccaggugcgagcacgcugaccuacucgccguuguggcggcaucucagaaaaagcaagccauuacggcucuggucgugguaucgauaguugcccuugcagugcugaucauuaccugugucuugauccauugcugucaggugcggaaacacugcgaauggugucgcgcucucauuugccgacacgagaagccaucagcccugcugaaagggcguacagcgugcugucauagcgaaacuguggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4170 - RNA, 1520 nt, Artificial Sequence
  mRNA product Design3 comprising derived and/or modified sequence from Homo sapiens__NP_000651.3__HsTGFB1 (opt3)
gggagagucccgcagucggcguccagcggcucugcuuguucgugugugugucguugcaggccuuauucaagcuuaccaugcccccuagcggccugagacuccuuccacuguuguuaccgcugcuauggcuccuggugcuuacccccgggaggccugccgcuggacuguccacaugcaagacuaucgacauggaguuggucaaacggaagcgcauugaagcaauacgaggucagauccucucuaaacugcgucuggccucaccacccagucaaggcgagguuccuccagggccccucccugaagcgguguuagcucuguacaacagcacgagagauaggguagccggagaguccgcagaaccagagccggagcccgaagccgacuauuacgcuaaggaggugacccggguccuuaugguggaaacacacaaugagauuuaugauaaauucaagcagucuacucauucgaucuacauguuuuucaacaccucagaguugcgcgaagcaguuccugagccagugcugcuaagcagagccgaacucaggcugcuucggcugaaguugaaagucgagcagcacguggaacucuaucagaaguacaguaauaacuccuggcgcuaucugucuaaucgauuacuggcucccagcgacuccccugaguggcucucauuugauguaacaggcguugugagacaauggcuuaguagggguggggagauugaaggauuccggcugagcgcccauuguucuugcgacucccgugauaacaccuugcaggucgacaucaauggcuuuacuacaggccgcagaggggaucuagcgaccauacacggaaugaacaggccauuccugcuccugauggcaacgccccuugagcgggcccagcaucugcagucaagccgacaccgcagagcuuuggacacuaauuacuguuuuaguucuaccgagaaaaacugcugugugaggcaacucuacaucgauuuccggaaggaccuggguuggaaauggauucacgaaccgaagggcuaucaugccaauuuuugcuuagggccuugucccuacaucuggucccuggauacacaguauagcaaggugcuagcacucuacaaccagcacaauccaggagcuucggccgcgccuugcugugucccccaggcccuggaaccacuucccauuguuuauuacgugggccgcaaaccuaagguagagcaauugucuaacaugaucgugagauccugcaaauguucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4171 - RNA, 1592 nt, Artificial Sequence
  mRNA product Design3 comprising derived and/or modified sequence from Homo sapiens__NP_003229.1__HsTGFB2 (opt3)
gggagagucccgcagucggcguccagcggcucugcuuguucgugugugugucguugcaggccuuauucaagcuuaccaugcacuacugcgugcugagcgccuuccucauccuucaucuggucaccguugcuuuguccuuaucuacauguucaacucuggacauggaucaguuuaugagaaagaggauugaggcaauacggggccaaauccuaaguaaacucaagcugacgagcccucccgaagacuauccagagccggaagaggugcccccugaaguaauuuccaucuacaacucuacccgcgaucuucugcaggagaaagccucgcgacgugcggcugccugcgagagagaaaggucagacgaggaauauuacgcaaaggagguguauaaaauugauaugccacccuucuuuccuagcgagaaugccaucccacccacauucuaccggccuuauuuucgcauagucagauucgacgugagugcuauggaaaagaacgcauccaauuugguuaaggccgaguuuaggguguuccggcuccagaacccaaaagcucgcgucccggaacagcgaaucgagcuguaccaaauucugaagucuaaagaucucacuagccccacccagagauacaucgacuccaaggugguaaaaacaagggccgaaggggagugguuaucauuugauguuaccgacgcggugcacgaguggcugcaucacaaggaucggaaucuuggauucaagauuaguuugcauuguccuugcuguacuuuugucccaagcaacaauuauaucauacccaacaaaucugaggaacuggaagcacguuucgccgguauugacggcacauccaccuacacgucaggggaucagaagacuaucaaaagcacccgcaagaaaaauaguggaaagacaccucaccuacuccugaugcuucugccaucuuauagauuggagucccagcaaacuaacaggcggaaaaagcgagcucucgacgccgcauacugcuuucgcaaugugcaggacaacuguugccugagacccuuauauauugauuucaagagggaccugggcuggaaauggauccacgaaccgaaggguuacaaugcuaacuucugugccggggcgugcccuuaucucuggagcucggauacccagcauucucgggugcuuucccuguacaauacaaucaaccccgaggccucagcaaguccauguugcgucagccaggacuuggagccucuaaccauucuguacuauauaggaaaaacgcccaagaucgaacaacucuccaacaugauuguuaaaucuugcaaguguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4172 - RNA, 1586 nt, Artificial Sequence
  mRNA product Design3 comprising derived and/or modified sequence from Homo sapiens__NP_003230.1__HsTGFB3 (opt3)
gggagagucccgcagucggcguccagcggcucugcuuguucgugugugugucguugcaggccuuauucaagcuuaccaugaagaugcaucugcagagagcccucgugguccuugcucuguugaacuucgcaaccguuagcuuaucccugucuacaugcacuacgcuagacuuuggccacaucaaaaagaaaaggguggaggccauucgggggcaaauacucucaaagcugcgccuuaccagucccccugaaccaacaguaaugacucacgugccguaccagguccuggcguuguauaauagcacccgagagcuccuggaagagaugcauggagaacgugaggaggguuguacacaggaaaacaccgaguccgaauacuaugcuaaagagauccacaaguucgauaugauucagggccuggccgagcauaaugaacucgcagugugccccaaggggaucacuucuaaaguuuuuagauucaacgugucgucagucgagaagaauaggacaaacuuauuucgggccgaguuccgcgugcugagaguaccuaauccaagcaguaaaaggaacgaacaacggauugaacuuuuucagaucuugcgccccgacgagcacauagcuaagcagcgauacaucggaggcaaaaaucugccuaccagagguacggcagaguggcuauccuucgauguuacugacaccgugagggaauggcuccugcggcgugagucuaaccuugggcuggaaauuagcauccacuguccaugccauacauuucagcccaauggagauauuuuggagaacauccacgaagucauggagauaaaguucaagggcguggacaaugaggaugaccauggccgcggggaucucggaagacugaaaaagcaaaaagaccaccacaacccucauuuaauucugaugaugaucccaccgcacaggcucgauaaucccggucagggcgggcagcggaagaaacgagcccuugacacuaacuauuguuuucgcaaccuggaagagaauugcugugugagaccuuuguacauugauuucaggcaggaccuaggauggaaguggguccaugaaccaaaaggcuauuacgcuaacuuuugcuccggucccuguccuuaccugcggucagccgacaccacacacaguaccguucucgggcuguauaauacgcuuaacccagaggcgagcgcaucucccugcugugugccgcaagaucuggaaccuuugacuauccucuacuauguaggacgcacacccaagguggagcagcuguccaauauggucgugaagucaugcaaaugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4173 - RNA, 1733 nt, Artificial Sequence
  mRNA product Design3 comprising derived and/or modified sequence from Homo sapiens__NP_001057.1__HsTNFRSF1B (opt3)
gggagagucccgcagucggcguccagcggcucugcuuguucgugugugugucguugcaggccuuauucaagcuuaccauggcccccguggcugucugggcagcccuggcgguuggccucgagcuuugggcugccgcacacgcccugccugcucagguggcauucaccccauacgccccggaacccgggagcacaugcagauugagggaguauuacgaccaaacugcucagauguguugcuccaaguguucuccuggacagcaugccaaaguauuuugcacgaagaccucagauacagugugugacaguugcgaagauagcacuuauacccaguuauggaacugggucccagagugucuguccugcgguucucgguguucgucagaccaaguggaaacacaggcgugcacccgcgagcagaaucgaaucuguacuugccgucccggcugguacugcgcacuaagcaaacaggagggguguagacucugcgccccucugaggaagugucggccaggauucggcguugcucgccccgguacagaaaccagugauguggucugcaaaccuugugccccagggacguuuuccaacacuaccucuagcacagacauuugcagaccgcaccaaauauguaaugugguagcaauccccggaaacgcuuccauggaugccguuugcacuucaaccaguccuacaaggagcauggcgccaggcgccgugcaucuuccccagccugucucuacccggucccagcacacgcagccaacucccgagccgucaacagcaccuagcaccaguuuccuguugcccaugggcccaucuccucccgcugaaggguccacuggagacuuugcccucccagugggucugauugugggcgucacagcucuggggcucuuaaucauuggaguugugaauuguguaaucaugacccaagugaagaagaaaccccugugccuucagcgcgaggccaaggucccucauuugccagcagauaaagcccgaggcacgcaggguccggagcaacagcaucugcuaauaaccgcucccagcucgucuuccucaagucucgaaagcuccgcgucugcacuggacagaagggccccuacacggaaccagccacaggcucccgggguggaggccagcggagcaggcgaagcccgugcuucaacuggcaguuccgauagcucuccugggggacacgguacccaaguuaaugugacauguaucgucaacgugugcucaaguagcgaccacuccucucagugcucgagccaggccuccucaacuaugggcgauaccgacaguucuccaagcgagucccccaaggacgaacagguaccguucucaaaagaggagugugcauuucgcagccaacuugaaacaccugagacccuguuggggucuacugaagagaagccacucccccugggaguuccugaugcgggcaugaagcccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4174 - RNA, 860 nt, Artificial Sequence
  mRNA product Design3 comprising derived and/or modified sequence from Homo sapiens__NP_002623.2__HsPGF (opt3)
gggagagucccgcagucggcguccagcggcucugcuuguucgugugugugucguugcaggccuuauucaagcuuaccaugcccgugaugagacuguucccuugcuuucuccagcuucuggccggcuuggcuuuaccagcagucccgccccaacagugggcccugagcgcggggaacggauccucugagguugaagugguaccuuuccaggaggugugggguaggucauacugucgggcucuagaacgccucgucgacgugguuagugaguauccaagcgaaguggagcacauguuuucccccucuugcgucucgcugcuucgauguaccggcugcuguggggaugagaaucugcauugcgugccuguagaaacagccaacguuacuaugcaguugcucaagauccguucaggagacagaccaagcuacguggagcugacguucagucaacacgucaggugugaaugccggccccugcgcgagaaaaugaagccugagagaaggcggccaaaaggccgcgguaagcgaagaagggaaaaacagcggccgaccgauugucaucucugcggggacgcagugccccgucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4175 - RNA, 1586 nt, Artificial Sequence
  mRNA product Design3 comprising derived and/or modified sequence from Homo sapiens__NP_001020537.2__HsVEGFA (opt3)
gggagagucccgcagucggcguccagcggcucugcuuguucgugugugugucguugcaggccuuauucaagcuuaccaugaccgacagacagacagauacugcccccagcccuuccuaccaucugcucccaggcaggcggcgcacgguggacgcugcagccucucgagggcaaggaccggagcccgcgccugguggcggggucgaaggaguuggcgcucgugguguggcccuuaagcuguucguacaguuguuagggugcucaagauuuggaggcgcaguggucagggccggcgaggcugaaccaaguggggcagcccggagcgcuuccucuggacgcgaggaaccccagccugaggagggugaagaggaagaggagaaagaagaggaaagaggcccacaguggaggcugggggcccggaagcccggaucguggaccggcgaggcggcagugugugccgauucagcuccugccgcacgcgcuccacaagcccuagcgcgagccagcgguagagggggaaggguugcacggcguggcgcugaagagaguggcccgccccacuccccuucucgcagagggagcgccuccagggcuggaccaggucgggccucagagacaaugaacuuccuccugaguugggugcacuggagccuugcacuguugcucuaucugcaucacgccaaauggucucaggcugcgcccauggcagaaggcgggggacagaaucaucacgaggucgugaaguuuauggacguauaccagcgauccuauugccacccuaucgaaacucugguugauauuuuccaagaguacccagacgaaauagaguauaucuuuaaacccucaugugugccgcucaugcgcugcggcgguuguugcaacgaugagggguuagaaugugucccuaccgaggaaagcaauauuacaaugcagaucaugagaauuaagccccaucagggccagcacaucggagagaugaguuuccugcaacauaacaagugcgaauguaggccuaaaaaggaccgggcccgccaggagaaaaagucugugagaggcaaagggaagggacagaagaggaaacguaagaaaucccgguacaagagcuggucgguguaugucggugcucgaugcugucuuaugccauggucuuugcccggcccacaccccugcgggccuugcuccgagagaaggaaacaccuguuuguucaagauccacagaccuguaagugcucauguaaaaauacugacagucgcugcaaggcccggcagcuagaacucaacgagagaacauguaggugcgauaagccgcgccgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4176 - RNA, 1046 nt, Artificial Sequence
  mRNA product Design3 comprising derived and/or modified sequence from Homo sapiens__NP_001165094.1__HsVEGFA (opt3)
gggagagucccgcagucggcguccagcggcucugcuuguucgugugugugucguugcaggccuuauucaagcuuaccaugaacuuccugcucagcugggugcacuggucccuugcccuguuguuauaccugcaucacgcuaaguggucucaggcagcccccauggcggagggcgggggacaaaaucaucacgaagucguuaaauuuauggacguguaucagagaucauacugccauccuaucgagacccuaguagauauuuuccaggaauauccagacgagauagaauacaucuuuaagccgaguugugugccccucaugaggugcgguggcuguugcaacgaugaggggcuggagugugucccuacagaagagagcaauauuacuaugcagaucaugcggauuaaaccacaccaaggacagcacaucggcgaaauguccuuccuucagcauaacaagugcgagugucgccccaaaaaggaccgagcucgucaggagaagaaaucugugagagguaaggggaaaggacaaaagaggaaacggaagaagucgcgcuauaaaucauggagcguuuacgugggcgccagaugcugucugaugccuuggaguuugccaggcccccacccuugcgggccauguuccgaaaggcggaagcaucucuuuguccaggauccgcagacgugcaaaugcucuuguaagaauaccgacagccgcugcaaagcacgacagcuggagcugaacgaaagaacauguaggugcgauaagccccggcguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4177 - RNA, 971 nt, Artificial Sequence
  mRNA product Design3 comprising derived and/or modified sequence from Homo sapiens__NP_003368.1__HsVEGFB (opt3)
gggagagucccgcagucggcguccagcggcucugcuuguucgugugugugucguugcaggccuuauucaagcuuaccaugagcccccugcucagaaggcuucuguuggccgcuuuacugcagcuagccccugcacaagcgccagugucccagccggacgcucccggccaccagcggaaggucguuucuuggaucgauguguacacccgcgccacaugccagccucgagagguaguggucccacucacuguggaacugauggggacgguugcaaaacaacuugugcccucaugugucaccgugcagcguugcggagguuguugcccugacgauggccuggaguguguaccaacagggcagcaucagguuagaaugcaaauuuugaugauaagguaucccaguagccagcucggagaaaugucccuggaggaacacucucagugcgagugucggccuaagaaaaaggacucggccgugaaaccagaucgcgcugcaacuccgcaucacagaccccagccuaggucagucccaggcugggacagcgcccccggugcuccuaguccagccgauaucacccaucccacaccggcgccugggcccuccgcacacgccgcuccaucuaccacuagcgcccugacaccuggacccgcagcugccgcggccgacgcagcugccuccucaguggcuaagggcggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4178 - RNA, 1607 nt, Artificial Sequence
  mRNA product Design3 comprising derived and/or modified sequence from Homo sapiens__NP_005420.1__HsVEGFC (opt3)
gggagagucccgcagucggcguccagcggcucugcuuguucgugugugugucguugcaggccuuauucaagcuuaccaugcaccuucucggcuucuuuagcguggccugcucccuucuggcugcagccuuguuacccgggccuagagaggcgccagcugccgcagccgcuuucgaaucuggacuggaccuaucagaugcagagccggacgccggugaagcuaccgccuacgcgaguaaggaucucgaggaacagcugaggagcgucuccucuguugacgagcuuaugacagugcuguaucccgaguacuggaaaauguauaagugucaauugcggaaaggcggguggcagcauaaccgcgaacaggcaaaucucaacucgcgaacugaggaaacgaucaaguuugccgcugcccacuacaauaccgagauucugaaaucaauagauaacgaguggcguaagacacagugcaugccuagagaaguauguaucgacgugggaaaggaguucggcgucgcaacuaauaccuuuuucaaaccacccugcgugagcguuuauagguguggugggugcuguaacagugaaggacugcaaugcaugaauacauccaccucuuaccucagcaagacuuuauuugagauuacagugccucugucccagggcccaaaacccgucaccaucucauucgcuaaccauacgaguugucggugcaugagcaagcuggauguguaucgccagguacacucuauuaucagaagguccuugccugccacucugccacagugucaagcggccaauaaaaccugcccgacaaacuacauguggaauaaccauauaugccggugucuagcacaggaagacuuuauguucucaagcgaugcuggcgacgauaguacugacggguuucacgauaucugcggacccaauaaggagcucgacgaggaaaccugucagugcguuugucgcgccggucugcgaccugcuucuugcggcccacacaaggagcuugacagaaacuccugucagugcguguguaaaaauaagcuguuccccagccaaugcggggccaacagggaauuugaugagaacacaugucagugcgucugcaaacggaccuguccucguaaucagccauugaaccccggaaagugcgcaugugaaugcacggagucgccgcaaaaaugucuccugaagggcaaaaaguuccaucaccagacuugcucuuguuaccgcagaccuugcacaaauaggcagaaggccugugagcccgguuucuccuauucagaagaggugugccggugugugccaaguuacuggaaacgaccucagaugagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4179 - RNA, 1412 nt, Artificial Sequence
  mRNA product Design3 comprising derived and/or modified sequence from Homo sapiens__NP_004460.1__HsVEGFD (opt3)
gggagagucccgcagucggcguccagcggcucugcuuguucgugugugugucguugcaggccuuauucaagcuuaccauguacagagaguggguggucguuaacguguucaugaugcuguauguacagcucgugcaaggcagcuccaaugaacacgggcccgucaagaggucuucacagaguacccuugagcggagcgaacagcagauccgcgccgcuuccucucuggaggaauuguuacgaauuacacauucggaggacuggaaacuguggcguugcagacuaaggcucaagucauuuacuagcauggauagucgguccgcaucucaccgcagcacgagauucgccgcgaccuuuuacgacauagagacacugaaagugaucgaugaagaguggcaaaggacucaguguuccccucgggaaaccugcguugagguggcuucagagcuuggaaagaguacaaacaccuucuuuaaaccaccgugugucaauguguuccgcugcgguggcuguugcaacgaagagagccugauuuguaugaauacuucuacauccuauaucucaaagcaguuguuugaaauuagcguaccccucaccaguguuccugagcuggugccagucaagguggccaaccauacggggugcaaaugucugcccacugcaccucgacacccauacucuaucauaagaagguccauccagauucccgaagaggaccggugcagccauucgaagaaacucuguccuaucgauauguuaugggacucuaauaagugcaaaugcgugcugcaagaggaaaacccacuugccggaaccgaggaucacucccacuugcaggaaccggcucuguguggcccccauaugauguucgacgaggaucguugcgaaugugucugcaagacaccuuguccaaaggaccuaauucagcaccccaaaaauugcucauguuuugagugcaaggagagucucgaaacuuguugccagaaacauaagcuguuccacccugauaccuguagcugcgaggaccgcugcccauuucacacaagacccugugcauccgguaaaaccgccugcgcuaagcauuguagguucccgaaagaaaagcgggccgcgcaagggccucacucucgaaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4180 - RNA, 977 nt, Artificial Sequence
  mRNA product Design3 comprising derived and/or modified sequence from Homo sapiens__NP_061986.1__HsFGF21 (opt4)
gggagagucccgcagucggcguccagcggcucugcuuguucgugugugugucguugcaggccuuauucaagcuuaccauggacagcgacgagaccggcuucgagcacagcggccugugggugagcgugcuggccggccugcugcugggcgccugccaggcccaccccauccccgacagcagcccccugcugcaguucggcggccaggugagacagagauaccuguacaccgacgacgcccagcagaccgaggcccaccuggagaucagagaggacggcaccgugggcggcgccgccgaccagagccccgagagccugcugcagcugaaggcccugaagcccggcgugauccagauccugggcgugaagaccagcagauuccugugccagagacccgacggcgcccuguacggcagccugcacuucgaccccgaggccugcagcuucagagagcugcugcuggaggacggcuacaacguguaccagagcgaggcccacggccugccccugcaccugcccggcaacaagagcccccacagagaccccgcccccagaggccccgccagauuccugccccugcccggccugccccccgcccugcccgagccccccggcauccuggccccccagccccccgacgugggcagcagcgacccccugagcauggugggccccagccagggcagaagccccagcuacgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4181 - RNA, 1757 nt, Artificial Sequence
  mRNA product Design3 comprising derived and/or modified sequence from Homo sapiens__NP_002412.1__HsMMP1 (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuuccccgccacccuggagacccaggagcaggacguggaccuggugcagaaguaccuggagaaguacuacaaccugaagaacgacggcagacagguggagaagagaagaaacagcggccccgugguggagaagcugaagcagaugcaggaguucuucggccugaaggugaccggcaagcccgacgccgagacccugaaggugaugaagcagcccagaugcggcgugcccgacguggcccaguucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4182 - RNA, 1517 nt, Artificial Sequence
  mRNA product Design3 comprising derived and/or modified sequence from Homo sapiens__NP_002412.1__HsMMP1(1-19,100-469) (opt4)
gggagagucccgcagucggcguccagcggcucugcuuguucgugugugugucguugcaggccuuauucaagcuuaccaugcacagcuuccccccccugcugcugcugcuguucuggggcguggugagccacagcuucgugcugaccgagggcaaccccagaugggagcagacccaccugaccuacagaaucgagaacuacacccccgaccugcccagagccgacguggaccacgccaucgagaaggccuuccagcuguggagcaacgugaccccccugaccuucaccaaggugagcgagggccaggccgacaucaugaucagcuucgugagaggcgaccacagagacaacagccccuucgacggccccggcggcaaccuggcccacgccuuccagcccggccccggcaucggcggcgacgcccacuucgacgaggacgagagauggaccaacaacuucagagaguacaaccugcacagaguggccgcccacgagcugggccacagccugggccugagccacagcaccgacaucggcgcccugauguaccccagcuacaccuucagcggcgacgugcagcuggcccaggacgacaucgacggcauccaggccaucuacggcagaagccagaaccccgugcagcccaucggcccccagacccccaaggccugcgacagcaagcugaccuucgacgccaucaccaccaucagaggcgaggugauguucuucaaggacagauucuacaugagaaccaaccccuucuaccccgagguggagcugaacuucaucagcguguucuggccccagcugcccaacggccuggaggccgccuacgaguucgccgacagagacgaggugagauucuucaagggcaacaaguacugggccgugcagggccagaacgugcugcacggcuaccccaaggacaucuacagcagcuucggcuuccccagaaccgugaagcacaucgacgccgcccugagcgaggagaacaccggcaagaccuacuucuucguggccaacaaguacuggagauacgacgaguacaagagaagcauggaccccggcuaccccaagaugaucgcccacgacuuccccggcaucggccacaagguggacgccguguucaugaaggacggcuucuucuacuucuuccacggcaccagacaguacaaguucgaccccaagaccaagagaauccugacccugcagaaggccaacagcugguucaacugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4183 - RNA, 3704 nt, Artificial Sequence
  mRNA product Design3 comprising derived and/or modified sequence from Clostridium histolyticum__BAA77453.1__ColG (opt4)
gggagagucccgcagucggcguccagcggcucugcuuguucgugugugugucguugcaggccuuauucaagcuuaccaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4184 - RNA, 3428 nt, Artificial Sequence
  mRNA product Design3 comprising derived and/or modified sequence from Clostridium histolyticum__BAA77453.1__HsALB(1-18)_ColG(111-1118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4185 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4186 - RNA, 3452 nt, Artificial Sequence
  mRNA product Design3 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaacuuccugaagaucauccugaacagaggcaagaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4187 - RNA, 3413 nt, Artificial Sequence
  mRNA product Design3 comprising derived and/or modified sequence from Clostridium histolyticum__BAA34542.1__ColH (opt4)
gggagagucccgcagucggcguccagcggcucugcuuguucgugugugugucguugcaggccuuauucaagcuuaccaugaagagaaagugccugagcaagagacugaugcuggccaucaccauggccaccaucuucaccgugaacagcacccugcccaucuacgccgccguggacaagaacaacgccaccgccgccgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4188 - RNA, 3347 nt, Artificial Sequence
  mRNA product Design3 comprising derived and/or modified sequence from Clostridium histolyticum__BAA34542.1__HsALB(1-18)_ColH(41-1021) (opt4)
gggagagucccgcagucggcguccagcggcucugcuuguucgugugugugucguugcaggccuuauucaagcuuaccaugaagugggugaccuucaucagccugcuguuccuguucagcagcgccuacagcgugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4189 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt4)
gggagagucccgcagucggcguccagcggcucugcuuguucgugugugugucguugcaggccuuauucaagcuuaccaugaagugggugaccuucaucagccugcuguuccuguucagcagcgccuacagcaugaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4190 - RNA, 923 nt, Artificial Sequence
  mRNA product Design3 comprising derived and/or modified sequence from Homo sapiens__NP_001133.1__HsAMELX (opt4)
gggagagucccgcagucggcguccagcggcucugcuuguucgugugugugucguugcaggccuuauucaagcuuaccaugggcaccuggauccuguucgccugccugcugggcgccgccuucgccaugccccugcccccccaccccggccaccccggcuacaucaacuucagcuacgaggugcugaccccccugaagugguaccagagcaucagaccccccuaccccagcuacggcuacgagcccaugggcggcuggcugcaccaccagaucauccccgugcugagccagcagcacccccccacccacacccugcagccccaccaccacauccccguggugcccgcccagcagcccgugaucccccagcagcccaugaugcccgugcccggccagcacagcaugacccccauccagcaccaccagcccaaccugcccccccccgcccagcagcccuaccagccccagcccgugcagccccagccccaccagcccaugcagccccagccccccgugcaccccaugcagccccugcccccccagcccccccugccccccauguuccccaugcagccccugccccccaugcugcccgaccugacccuggaggccuggcccagcaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4191 - RNA, 482 nt, Artificial Sequence
  mRNA product Design3 comprising derived and/or modified sequence from Homo sapiens__NP_001133.1__HsAMELX-TRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaucagaccccccuaccccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4192 - RNA, 515 nt, Artificial Sequence
  mRNA product Design3 comprising derived and/or modified sequence from Homo sapiens__NP_001133.1__HsAMELX-LRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4193 - RNA, 554 nt, Artificial Sequence
  mRNA product Design3 comprising derived and/or modified sequence from Homo sapiens__NP_001133.1__HLA-A2-SP_HsAMELX(17-60) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagaccccccuaccccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4194 - RNA, 587 nt, Artificial Sequence
  mRNA product Design3 comprising derived and/or modified sequence from Homo sapiens__NP_001133.1__HLA-A2-SP_HsAMELX(17-47,168-191) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaucagacccccccccaugcugcccgaccugacccuggaggccuggcccagcaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4195 - RNA, 926 nt, Artificial Sequence
  mRNA product Design3 comprising derived and/or modified sequence from Homo sapiens__NP_001134.1__HsAMELY (opt4)
gggagagucccgcagucggcguccagcggcucugcuuguucgugugugugucguugcaggccuuauucaagcuuaccaugggcaccuggauccuguucgccugccuggugggcgccgccuucgccaugccccugcccccccaccccggccaccccggcuacaucaacuucagcuacgaggugcugaccccccugaagugguaccagagcaugaucagaccccccuacagcagcuacggcuacgagcccaugggcggcuggcugcaccaccagaucauccccguggugagccagcagcacccccugacccacacccugcagagccaccaccacauccccguggugcccgcccagcagcccagagugagacagcaggcccugaugcccgugcccggccagcagagcaugacccccacccagcaccaccagcccaaccugccccugcccgcccagcagcccuuccagccccagcccgugcagccccagccccaccagcccaugcagccccagccccccgugcagcccaugcagccccugcugccccagcccccccugccccccauguucccccugagaccccugccccccauccugcccgaccugcaccuggaggccuggcccgccaccgacaagaccaagcaggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4196 - RNA, 485 nt, Artificial Sequence
  mRNA product Design3 comprising derived and/or modified sequence from Homo sapiens__NP_001134.1__HsAMELY-TRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4197 - RNA, 518 nt, Artificial Sequence
  mRNA product Design3 comprising derived and/or modified sequence from Homo sapiens__NP_001134.1__HsAMELY-LRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4198 - RNA, 557 nt, Artificial Sequence
  mRNA product Design3 comprising derived and/or modified sequence from Homo sapiens__NP_001134.1__HLA-A2-SP_HsAMELY(17-61) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagaccccccuacagcagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4199 - RNA, 590 nt, Artificial Sequence
  mRNA product Design3 comprising derived and/or modified sequence from Homo sapiens__NP_001134.1__HLA-A2-SP_HsAMELY(17-48,169-192) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagagcaugaucagacccccccccauccugcccgaccugcaccuggaggccuggcccgccaccgacaagaccaagcaggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4200 - RNA, 917 nt, Artificial Sequence
  mRNA product Design3 comprising derived and/or modified sequence from Sus scrofa__NP_999071.1__SsAMELX-001-1 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4201 - RNA, 485 nt, Artificial Sequence
  mRNA product Design3 comprising derived and/or modified sequence from Sus scrofa__NP_999071.1__SsAMELX-TRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4202 - RNA, 518 nt, Artificial Sequence
  mRNA product Design3 comprising derived and/or modified sequence from Sus scrofa__NP_999071.1__SsAMELX-LRAP (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4203 - RNA, 557 nt, Artificial Sequence
  mRNA product Design3 comprising derived and/or modified sequence from Sus scrofa__NP_999071.1__HLA-A2-SP_SsAMEL(17-61) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccuacaccagcuacggcuacgagcccaugggcggcuggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4204 - RNA, 590 nt, Artificial Sequence
  mRNA product Design3 comprising derived and/or modified sequence from Sus scrofa__NP_999071.1__HLA-A2-SP_SsAMEL(17-49,167-189) (opt4)
gggagagucccgcagucggcguccagcggcucugcuuguucgugugugugucguugcaggccuuauucaagcuuaccauggccgugauggcccccagaacccuggugcugcugcugagcggcgcccuggcccugacccagaccugggccaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4205 - RNA, 881 nt, Artificial Sequence
  mRNA product Design3 comprising derived and/or modified sequence from Sus scrofa__P45561-2__SsAMELX-001-2 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4206 - RNA, 917 nt, Artificial Sequence
  mRNA product Design3 comprising derived and/or modified sequence from Sus scrofa__NP_998965.1__SsAMELX-001-3 (opt4)
gggagagucccgcagucggcguccagcggcucugcuuguucgugugugugucguugcaggccuuauucaagcuuaccaugggcaccuggaucuucuucgccugccugcugggcgccagccuggccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4207 - RNA, 566 nt, Artificial Sequence
  mRNA product Design3 comprising derived and/or modified sequence from Sus scrofa__K7GPB2__SsAMELX-002 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4208 - RNA, 959 nt, Artificial Sequence
  mRNA product Design3 comprising derived and/or modified sequence from Sus scrofa__K7GLD0__SsAMELX-003 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggaccuguaccuggaggccaucagaaucgacagaaccgccuucgugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4209 - RNA, 845 nt, Artificial Sequence
  mRNA product Design3 comprising derived and/or modified sequence from Sus scrofa__K7GPE9__SsAMELX-004 (opt4)
gggagagucccgcagucggcguccagcggcucugcuuguucgugugugugucguugcaggccuuauucaagcuuaccaugggcaccuggauccuguucgccugccugcugggcgccgccuucagcaugccccugcccccccaccccggccaccccggcuacaucaacuucagcuacgaggugcugaccccccugaagugguaccagaacaugaucagacaccccaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4210 - RNA, 869 nt, Artificial Sequence
  mRNA product Design3 comprising derived and/or modified sequence from Sus scrofa__J9JIM4__SsAMELX-201 (opt4)
gggagagucccgcagucggcguccagcggcucugcuuguucgugugugugucguugcaggccuuauucaagcuuaccaugccccugcccccccaccccggccaccccggcuacaucaacuucagcuacgaggugcugaccccccugaagugguaccagaacaugaucagacaccccuacaccagcuacggcuacgagcccaugggcggcuggcugcaccaccagaucauccccguggugagccagcagaccccccagagccacgcccugcagccccaccaccacauccccauggugcccgcccagcagcccggcaucccccagcagcccaugaugccccugcccggccagcacagcaugacccccacccagcaccaccagcccaaccugccccugcccgcccagcagcccuuccagccccagcccgugcagccccagccccaccagccccugcagccccagagccccaugcaccccauccagccccugcugccccagcccccccugccccccauguucagcaugcagagccugcugcccgaccugccccuggaggccuggcccgccaccgacaagaccaagagagaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4211 - RNA, 3308 nt, Artificial Sequence
  mRNA product Design3 comprising derived and/or modified sequence from Homo sapiens__NP_006120.1__HsBMP1 (opt4)
gggagagucccgcagucggcguccagcggcucugcuuguucgugugugugucguugcaggccuuauucaagcuuaccaugcccggcguggccagacugccccugcugcugggccugcugcugcugcccagacccggcagaccccuggaccuggccgacuacaccuacgaccuggccgaggaggacgacagcgagccccugaacuacaaggaccccugcaaggccgccgccuuccugggcgacaucgcccuggacgaggaggaccugagagccuuccaggugcagcaggccguggaccugagaagacacaccgccagaaagagcagcaucaaggccgccgugcccggcaacaccagcacccccagcugccagagcaccaacggccagccccagagaggcgccugcggcagauggagaggcagaagcagaagcagaagagccgccaccagcagacccgagagaguguggcccgacggcgugauccccuucgugaucggcggcaacuucaccggcagccagagagccguguucagacaggccaugagacacugggagaagcacaccugcgugaccuuccuggagagaaccgacgaggacagcuacaucguguucaccuacagacccugcggcugcugcagcuacgugggcagaagaggcggcggcccccaggccaucagcaucggcaagaacugcgacaaguucggcaucguggugcacgagcugggccacguggugggcuucuggcacgagcacaccagacccgacagagacagacacgugagcaucgugagagagaacauccagcccggccaggaguacaacuuccugaagauggagccccaggagguggagagccugggcgagaccuacgacuucgacagcaucaugcacuacgccagaaacaccuucagcagaggcaucuuccuggacaccaucgugcccaaguacgaggugaacggcgugaagccccccaucggccagagaaccagacugagcaagggcgacaucgcccaggccagaaagcuguacaagugccccgccugcggcgagacccugcaggacagcaccggcaacuucagcagccccgaguaccccaacggcuacagcgcccacaugcacugcguguggagaaucagcgugacccccggcgagaagaucauccugaacuucaccagccuggaccuguacagaagcagacugugcugguacgacuacguggaggugagagacggcuucuggagaaaggccccccugagaggcagauucugcggcagcaagcugcccgagcccaucgugagcaccgacagcagacuguggguggaguucagaagcagcagcaacugggugggcaagggcuucuucgccguguacgaggccaucugcggcggcgacgugaagaaggacuacggccacauccagagccccaacuaccccgacgacuacagacccagcaaggugugcaucuggagaauccaggugagcgagggcuuccacgugggccugaccuuccagagcuucgagaucgagagacacgacagcugcgccuacgacuaccuggaggugagagacggccacagcgagagcagcacccugaucggcagauacugcggcuacgagaagcccgacgacaucaagagcaccagcagcagacuguggcugaaguucgugagcgacggcagcaucaacaaggccggcuucgccgugaacuucuucaaggagguggacgagugcagcagacccaacagaggcggcugcgagcagagaugccugaacacccugggcagcuacaagugcagcugcgaccccggcuacgagcuggcccccgacaagagaagaugcgaggccgccugcggcggcuuccugaccaagcugaacggcagcaucaccagccccggcuggcccaaggaguacccccccaacaagaacugcaucuggcagcugguggcccccacccaguacagaaucagccugcaguucgacuucuucgagaccgagggcaacgacgugugcaaguacgacuucguggaggugagaagcggccugaccgccgacagcaagcugcacggcaaguucugcggcagcgagaagcccgaggugaucaccagccaguacaacaacaugagaguggaguucaagagcgacaacaccgugagcaagaagggcuucaaggcccacuucuucagcgacaaggacgagugcagcaaggacaacggcggcugccagcaggacugcgugaacaccuucggcagcuacgagugccagugcagaagcggcuucgugcugcacgacaacaagcacgacugcaaggaggccggcugcgaccacaaggugaccagcaccagcggcaccaucaccagccccaacuggcccgacaaguaccccagcaagaaggagugcaccugggccaucagcagcacccccggccacagagugaagcugaccuucauggagauggacaucgagagccagcccgagugcgccuacgaccaccuggagguguucgacggcagagacgccaaggcccccgugcugggcagauucugcggcagcaagaagcccgagcccgugcuggccaccggcagcagaauguuccugagauucuacagcgacaacagcgugcagagaaagggcuuccaggccagccacgccaccgagugcggcggccaggugagagccgacgugaagaccaaggaccuguacagccacgcccaguucggcgacaacaacuaccccggcggcguggacugcgagugggugaucguggccgaggagggcuacggcguggagcugguguuccagaccuucgagguggaggaggagaccgacugcggcuacgacuacauggagcuguucgacggcuacgacagcaccgcccccagacugggcagauacugcggcagcggcccccccgaggagguguacagcgccggcgacagcgugcuggugaaguuccacagcgacgacaccaucaccaagaagggcuuccaccugagauacaccagcaccaaguuccaggacacccugcacagcagaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4212 - RNA, 1538 nt, Artificial Sequence
  mRNA product Design3 comprising derived and/or modified sequence from Homo sapiens__NP_001191.1__HsBMP2 (opt4)
gggagagucccgcagucggcguccagcggcucugcuuguucgugugugugucguugcaggccuuauucaagcuuaccaugguggccggcaccagaugccugcuggcccugcugcugccccaggugcugcugggcggcgccgccggccuggugcccgagcugggcagaagaaaguucgccgccgccagcagcggcagacccagcagccagcccagcgacgaggugcugagcgaguucgagcugagacugcugagcauguucggccugaagcagagacccacccccagcagagacgccguggugccccccuacaugcuggaccuguacagaagacacagcggccagcccggcagccccgcccccgaccacagacuggagagagccgccagcagagccaacaccgugagaagcuuccaccacgaggagagccuggaggagcugcccgagaccagcggcaagaccaccagaagauucuucuucaaccugagcagcauccccaccgaggaguucaucaccagcgccgagcugcagguguucagagagcagaugcaggacgcccugggcaacaacagcagcuuccaccacagaaucaacaucuacgagaucaucaagcccgccaccgccaacagcaaguuccccgugaccagacugcuggacaccagacuggugaaccagaacgccagcagaugggagagcuucgacgugacccccgccgugaugagauggaccgcccagggccacgccaaccacggcuucgugguggagguggcccaccuggaggagaagcagggcgugagcaagagacacgugagaaucagcagaagccugcaccaggacgagcacagcuggagccagaucagaccccugcuggugaccuucggccacgacggcaagggccacccccugcacaagagagagaagagacaggccaagcacaagcagagaaagagacugaagagcagcugcaagagacacccccuguacguggacuucagcgacgugggcuggaacgacuggaucguggccccccccggcuaccacgccuucuacugccacggcgagugccccuucccccuggccgaccaccugaacagcaccaaccacgccaucgugcagacccuggugaacagcgugaacagcaagauccccaaggccugcugcgugcccaccgagcugagcgccaucagcaugcuguaccuggacgagaacgagaagguggugcugaagaacuaccaggacauggugguggagggcugcggcugcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4213 - RNA, 1574 nt, Artificial Sequence
  mRNA product Design3 comprising derived and/or modified sequence from Homo sapiens__NP_001193.2__HsBMP4 (opt4)
gggagagucccgcagucggcguccagcggcucugcuuguucgugugugugucguugcaggccuuauucaagcuuaccaugauccccggcaacagaaugcugaugguggugcugcugugccaggugcugcugggcggcgccagccacgccagccugauccccgagaccggcaagaagaagguggccgagauccagggccacgccggcggcagaagaagcggccagagccacgagcugcugagagacuucgaggccacccugcugcagauguucggccugagaagaagaccccagcccagcaagagcgccgugauccccgacuacaugagagaccuguacagacugcagagcggcgaggaggaggaggagcagauccacagcaccggccuggaguaccccgagagacccgccagcagagccaacaccgugagaagcuuccaccacgaggagcaccuggagaacauccccggcaccagcgagaacagcgccuucagauuccuguucaaccugagcagcauccccgagaacgaggugaucagcagcgccgagcugagacuguucagagagcagguggaccagggccccgacugggagagaggcuuccacagaaucaacaucuacgaggugaugaagccccccgccgagguggugcccggccaccugaucaccagacugcuggacaccagacuggugcaccacaacgugaccagaugggagaccuucgacgugagccccgccgugcugagauggaccagagagaagcagcccaacuacggccuggccaucgaggugacccaccugcaccagaccagaacccaccagggccagcacgugagaaucagcagaagccugccccagggcagcggcaacugggcccagcugagaccccugcuggugaccuucggccacgacggcagaggccacgcccugaccagaagaagaagagccaagagaagccccaagcaccacagccagagagccagaaagaagaacaagaacugcagaagacacagccuguacguggacuucagcgacgugggcuggaacgacuggaucguggccccccccggcuaccaggccuucuacugccacggcgacugccccuucccccuggccgaccaccugaacagcaccaaccacgccaucgugcagacccuggugaacagcgugaacagcagcauccccaaggccugcugcgugcccaccgagcugagcgccaucagcaugcuguaccuggacgaguacgacaagguggugcugaagaacuaccaggagauggugguggagggcugcggcugcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4214 - RNA, 1889 nt, Artificial Sequence
  mRNA product Design3 comprising derived and/or modified sequence from Homo sapiens__NP_001709.1__HsBMP6 (opt4)
gggagagucccgcagucggcguccagcggcucugcuuguucgugugugugucguugcaggccuuauucaagcuuaccaugcccggccugggcagaagagcccaguggcugugcuggugguggggccugcugugcagcugcugcggcccccccccccugagacccccccugcccgccgccgccgccgccgccgccggcggccagcugcugggcgacggcggcagccccggcagaaccgagcagcccccccccagcccccagagcagcagcggcuuccuguacagaagacugaagacccaggagaagagagagaugcagaaggagauccugagcgugcugggccugccccacagacccagaccccugcacggccugcagcagccccagccccccgcccugagacagcaggaggagcagcagcagcagcagcagcugcccagaggcgagcccccccccggcagacugaagagcgccccccuguucaugcuggaccuguacaacgcccugagcgccgacaacgacgaggacggcgccagcgagggcgagagacagcagagcuggccccacgaggccgccagcagcagccagagaagacagcccccccccggcgccgcccacccccugaacagaaagagccugcuggcccccggcagcggcagcggcggcgccagcccccugaccagcgcccaggacagcgccuuccugaacgacgccgacauggugaugagcuucgugaaccugguggaguacgacaaggaguucagccccagacagagacaccacaaggaguucaaguucaaccugagccagauccccgagggcgagguggugaccgccgccgaguucagaaucuacaaggacugcgugaugggcagcuucaagaaccagaccuuccugaucagcaucuaccaggugcugcaggagcaccagcacagagacagcgaccuguuccugcuggacaccagaguggugugggccagcgaggagggcuggcuggaguucgacaucaccgccaccagcaaccuguggguggugaccccccagcacaacaugggccugcagcugagcguggugaccagagacggcgugcacgugcaccccagagccgccggccuggugggcagagacggccccuacgacaagcagcccuucaugguggccuucuucaaggugagcgaggugcacgugagaaccaccagaagcgccagcagcagaagaagacagcagagcagaaacagaagcacccagagccaggacguggccagagugagcagcgccagcgacuacaacagcagcgagcugaagaccgccugcagaaagcacgagcuguacgugagcuuccaggaccugggcuggcaggacuggaucaucgcccccaagggcuacgccgccaacuacugcgacggcgagugcagcuucccccugaacgcccacaugaacgccaccaaccacgccaucgugcagacccuggugcaccugaugaaccccgaguacgugcccaagcccugcugcgcccccaccaagcugaacgccaucagcgugcuguacuucgacgacaacagcaacgugauccugaagaaguacagaaacaugguggugagagccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4215 - RNA, 1643 nt, Artificial Sequence
  mRNA product Design3 comprising derived and/or modified sequence from Homo sapiens__NP_001710.1__HsBMP7 (opt4)
gggagagucccgcagucggcguccagcggcucugcuuguucgugugugugucguugcaggccuuauucaagcuuaccaugcacgugagaagccugagagccgccgccccccacagcuucguggcccugugggccccccuguuccugcugagaagcgcccuggccgacuucagccuggacaacgaggugcacagcagcuucauccacagaagacugagaagccaggagagaagagagaugcagagagagauccugagcauccugggccugccccacagacccagaccccaccugcagggcaagcacaacagcgcccccauguucaugcuggaccuguacaacgccauggccguggaggagggcggcggccccggcggccagggcuucagcuaccccuacaaggccguguucagcacccagggccccccccuggccagccugcaggacagccacuuccugaccgacgccgacauggugaugagcuucgugaaccugguggagcacgacaaggaguucuuccaccccagauaccaccacagagaguucagauucgaccugagcaagauccccgagggcgaggccgugaccgccgccgaguucagaaucuacaaggacuacaucagagagagauucgacaacgagaccuucagaaucagcguguaccaggugcugcaggagcaccugggcagagagagcgaccuguuccugcuggacagcagaacccugugggccagcgaggagggcuggcugguguucgacaucaccgccaccagcaaccacuggguggugaaccccagacacaaccugggccugcagcugagcguggagacccuggacggccagagcaucaaccccaagcuggccggccugaucggcagacacggcccccagaacaagcagcccuucaugguggccuucuucaaggccaccgaggugcacuucagaagcaucagaagcaccggcagcaagcagagaagccagaacagaagcaagacccccaagaaccaggaggcccugagaauggccaacguggccgagaacagcagcagcgaccagagacaggccugcaagaagcacgagcuguacgugagcuucagagaccugggcuggcaggacuggaucaucgcccccgagggcuacgccgccuacuacugcgagggcgagugcgccuucccccugaacagcuacaugaacgccaccaaccacgccaucgugcagacccuggugcacuucaucaaccccgagaccgugcccaagcccugcugcgcccccacccagcugaacgccaucagcgugcuguacuucgacgacagcagcaacgugauccugaagaaguacagaaacaugguggugagagccugcggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4216 - RNA, 647 nt, Artificial Sequence
  mRNA product Design3 comprising derived and/or modified sequence from Homo sapiens__NP_006264.2__HsCCL7 (opt4)
gggagagucccgcagucggcguccagcggcucugcuuguucgugugugugucguugcaggccuuauucaagcuuaccaugaaggccagcgccgcccugcugugccugcugcugaccgccgccgccuucagcccccagggccuggcccagcccgugggcaucaacaccagcaccaccugcugcuacagauucaucaacaagaagauccccaagcagagacuggagagcuacagaagaaccaccagcagccacugccccagagaggccgugaucuucaagaccaagcuggacaaggagaucugcgccgaccccacccagaagugggugcaggacuucaugaagcaccuggacaagaagacccagacccccaagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4217 - RNA, 3971 nt, Artificial Sequence
  mRNA product Design3 comprising derived and/or modified sequence from Homo sapiens__NP_001954.2__HsEGF (opt4)
gggagagucccgcagucggcguccagcggcucugcuuguucgugugugugucguugcaggccuuauucaagcuuaccaugcugcugacccugaucauccugcugcccguggugagcaaguucagcuucgugagccugagcgccccccagcacuggagcugccccgagggcacccuggccggcaacggcaacagcaccugcgugggccccgcccccuuccugaucuucagccacggcaacagcaucuucagaaucgacaccgagggcaccaacuacgagcagcuggugguggacgccggcgugagcgugaucauggacuuccacuacaacgagaagagaaucuacuggguggaccuggagagacagcugcugcagagaguguuccugaacggcagcagacaggagagagugugcaacaucgagaagaacgugagcggcauggccaucaacuggaucaacgaggaggugaucuggagcaaccagcaggagggcaucaucaccgugaccgacaugaagggcaacaacagccacauccugcugagcgcccugaaguaccccgccaacguggccguggaccccguggagagauucaucuucuggagcagcgagguggccggcagccuguacagagccgaccuggacggcgugggcgugaaggcccugcuggagaccagcgagaagaucaccgccgugagccuggacgugcuggacaagagacuguucuggauccaguacaacagagagggcagcaacagccugaucugcagcugcgacuacgacggcggcagcgugcacaucagcaagcaccccacccagcacaaccuguucgccaugagccuguucggcgacagaaucuucuacagcaccuggaagaugaagaccaucuggaucgccaacaagcacaccggcaaggacauggugagaaucaaccugcacagcagcuucgugccccugggcgagcugaagguggugcacccccuggcccagcccaaggccgaggacgacaccugggagcccgagcagaagcugugcaagcugagaaagggcaacugcagcagcaccgugugcggccaggaccugcagagccaccugugcaugugcgccgagggcuacgcccugagcagagacagaaaguacugcgaggacgugaacgagugcgccuucuggaaccacggcugcacccugggcugcaagaacacccccggcagcuacuacugcaccugccccgugggcuucgugcugcugcccgacggcaagagaugccaccagcuggugagcugccccagaaacgugagcgagugcagccacgacugcgugcugaccagcgagggcccccugugcuucugccccgagggcagcgugcuggagagagacggcaagaccugcagcggcugcagcagccccgacaacggcggcugcagccagcugugcgugccccugagccccgugagcugggagugcgacugcuuccccggcuacgaccugcagcuggacgagaagagcugcgccgccagcggcccccagcccuuccugcuguucgccaacagccaggacaucagacacaugcacuucgacggcaccgacuacggcacccugcugagccagcagaugggcaugguguacgcccuggaccacgaccccguggagaacaagaucuacuucgcccacaccgcccugaaguggaucgagagagccaacauggacggcagccagagagagagacugaucgaggagggcguggacgugcccgagggccuggccguggacuggaucggcagaagauucuacuggaccgacagaggcaagagccugaucggcagaagcgaccugaacggcaagagaagcaagaucaucaccaaggagaacaucagccagcccagaggcaucgccgugcaccccauggccaagagacuguucuggaccgacaccggcaucaaccccagaaucgagagcagcagccugcagggccugggcagacuggugaucgccagcagcgaccugaucuggcccagcggcaucaccaucgacuuccugaccgacaagcuguacuggugcgacgccaagcagagcgugaucgagauggccaaccuggacggcagcaagagaagaagacugacccagaacgacgugggccaccccuucgccguggccguguucgaggacuacgugugguucagcgacugggccaugcccagcgugaugagagugaacaagagaaccggcaaggacagagugagacugcagggcagcaugcugaagcccagcagccuggugguggugcacccccuggccaagcccggcgccgaccccugccuguaccagaacggcggcugcgagcacaucugcaagaagagacugggcaccgccuggugcagcugcagagagggcuucaugaaggccagcgacggcaagaccugccuggcccuggacggccaccagcugcuggccggcggcgagguggaccugaagaaccaggugaccccccuggacauccugagcaagaccagagugagcgaggacaacaucaccgagagccagcacaugcugguggccgagaucauggugagcgaccaggacgacugcgcccccgugggcugcagcauguacgccagaugcaucagcgagggcgaggacgccaccugccagugccugaagggcuucgccggcgacggcaagcugugcagcgacaucgacgagugcgagaugggcgugcccgugugcccccccgccagcagcaagugcaucaacaccgagggcggcuacgugugcagaugcagcgagggcuaccagggcgacggcauccacugccuggacaucgacgagugccagcugggcgagcacagcugcggcgagaacgccagcugcaccaacaccgagggcggcuacaccugcaugugcgccggcagacugagcgagcccggccugaucugccccgacagcaccccccccccccaccugagagaggacgaccaccacuacagcgugagaaacagcgacagcgagugcccccugagccacgacggcuacugccugcacgacggcgugugcauguacaucgaggcccuggacaaguacgccugcaacugcguggugggcuacaucggcgagagaugccaguacagagaccugaaguggugggagcugagacacgccggccacggccagcagcagaaggugaucgugguggccgugugcgugguggugcuggugaugcugcugcugcugagccuguggggcgcccacuacuacagaacccagaagcugcugagcaagaaccccaagaaccccuacgaggagagcagcagagacgugagaagcagaagacccgccgacaccgaggacggcaugagcagcugcccccagcccugguucguggugaucaaggagcaccaggaccugaagaacggcggccagcccguggccggcgaggacggccaggccgccgacggcagcaugcagcccaccagcuggagacaggagccccagcugugcggcaugggcaccgagcagggcugcuggauccccgugagcagcgacaagggcagcugcccccaggugauggagagaagcuuccacaugcccagcuacggcacccagacccuggagggcggcguggagaagccccacagccugcugagcgccaacccccuguggcagcagagagcccuggaccccccccaccagauggagcugacccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4218 - RNA, 857 nt, Artificial Sequence
  mRNA product Design3 comprising derived and/or modified sequence from Homo sapiens__NP_001423.1__HsEREG (opt4)
gggagagucccgcagucggcguccagcggcucugcuuguucgugugugugucguugcaggccuuauucaagcuuaccaugaccgccggcagaagaauggagaugcugugcgccggcagagugcccgcccugcugcugugccugggcuuccaccugcugcaggccgugcugagcaccaccgugauccccagcugcauccccggcgagagcagcgacaacugcaccgcccuggugcagaccgaggacaaccccagaguggcccaggugagcaucaccaagugcagcagcgacaugaacggcuacugccugcacggccagugcaucuaccugguggacaugagccagaacuacugcagaugcgaggugggcuacaccggcgugagaugcgagcacuucuuccugaccgugcaccagccccugagcaaggaguacguggcccugaccgugauccugaucauccuguuccugaucaccguggugggcagcaccuacuacuucugcagaugguacagaaacagaaagagcaaggagcccaagaaggaguacgagagagugaccagcggcgaccccgagcugccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4219 - RNA, 815 nt, Artificial Sequence
  mRNA product Design3 comprising derived and/or modified sequence from Homo sapiens__NP_000791.1__HsFGF1 (opt4)
gggagagucccgcagucggcguccagcggcucugcuuguucgugugugugucguugcaggccuuauucaagcuuaccauggccgagggcgagaucaccaccuucaccgcccugaccgagaaguucaaccugccccccggcaacuacaagaagcccaagcugcuguacugcagcaacggcggccacuuccugagaauccugcccgacggcaccguggacggcaccagagacagaagcgaccagcacauccagcugcagcugagcgccgagagcgugggcgagguguacaucaagagcaccgagaccggccaguaccuggccauggacaccgacggccugcuguacggcagccagacccccaacgaggagugccuguuccuggagagacuggaggagaaccacuacaacaccuacaucagcaagaagcacgccgagaagaacugguucgugggccugaagaagaacggcagcugcaagagaggccccagaacccacuacggccagaaggccauccuguuccugccccugcccgugagcagcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4220 - RNA, 1214 nt, Artificial Sequence
  mRNA product Design3 comprising derived and/or modified sequence from Homo sapiens__NP_001997.5__HsFGF2 (opt4)
gggagagucccgcagucggcguccagcggcucugcuuguucgugugugugucguugcaggccuuauucaagcuuaccauggugggcgugggcggcggcgacguggaggacgugacccccagacccggcggcugccagaucagcggcagaggcgccagaggcugcaacggcauccccggcgccgccgccugggaggccgcccugcccagaagaagacccagaagacaccccagcgugaaccccagaagcagagccgccggcagccccagaaccagaggcagaagaaccgaggagagacccagcggcagcagacugggcgacagaggcagaggcagagcccugcccggcggcagacugggcggcagaggcagaggcagagcccccgagagagugggcggcagaggcagaggcagaggcaccgccgcccccagagccgcccccgccgccagaggcagcagacccggccccgccggcaccauggccgccggcagcaucaccacccugcccgcccugcccgaggacggcggcagcggcgccuucccccccggccacuucaaggaccccaagagacuguacugcaagaacggcggcuucuuccugagaauccaccccgacggcagaguggacggcgugagagagaagagcgacccccacaucaagcugcagcugcaggccgaggagagaggcguggugagcaucaagggcgugugcgccaacagauaccuggccaugaaggaggacggcagacugcuggccagcaagugcgugaccgacgagugcuucuucuucgagagacuggagagcaacaacuacaacaccuacagaagcagaaaguacaccagcugguacguggcccugaagagaaccggccaguacaagcugggcagcaagaccggccccggccagaaggccauccuguuccugcccaugagcgccaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4221 - RNA, 932 nt, Artificial Sequence
  mRNA product Design3 comprising derived and/or modified sequence from Homo sapiens__NP_002000.1__HsFGF7 (opt4)
gggagagucccgcagucggcguccagcggcucugcuuguucgugugugugucguugcaggccuuauucaagcuuaccaugcacaaguggauccugaccuggauccugcccacccugcuguacagaagcugcuuccacaucaucugccuggugggcaccaucagccuggccugcaacgacaugacccccgagcagauggccaccaacgugaacugcagcagccccgagagacacaccagaagcuacgacuacauggagggcggcgacaucagagugagaagacuguucugcagaacccagugguaccugagaaucgacaagagaggcaaggugaagggcacccaggagaugaagaacaacuacaacaucauggagaucagaaccguggccgugggcaucguggccaucaagggcguggagagcgaguucuaccuggccaugaacaaggagggcaagcuguacgccaagaaggagugcaacgaggacugcaacuucaaggagcugauccuggagaaccacuacaacaccuacgccagcgccaaguggacccacaacggcggcgagauguucguggcccugaaccagaagggcauccccgugagaggcaagaagaccaagaaggagcagaagaccgcccacuuccugcccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4222 - RNA, 974 nt, Artificial Sequence
  mRNA product Design3 comprising derived and/or modified sequence from Homo sapiens__NP_001936.1__HsHBEGF (opt4)
gggagagucccgcagucggcguccagcggcucugcuuguucgugugugugucguugcaggccuuauucaagcuuaccaugaagcugcugcccagcguggugcugaagcuguuccuggccgccgugcugagcgcccuggugaccggcgagagccuggagagacugagaagaggccuggccgccggcaccagcaaccccgacccccccaccgugagcaccgaccagcugcugccccugggcggcggcagagacagaaaggugagagaccugcaggaggccgaccuggaccugcugagagugacccugagcagcaagccccaggcccuggccacccccaacaaggaggagcacggcaagagaaagaagaagggcaagggccugggcaagaagagagaccccugccugagaaaguacaaggacuucugcauccacggcgagugcaaguacgugaaggagcugagagcccccagcugcaucugccaccccggcuaccacggcgagagaugccacggccugagccugcccguggagaacagacuguacaccuacgaccacaccaccauccuggccgugguggccguggugcugagcagcgugugccugcuggugaucgugggccugcugauguucagauaccacagaagaggcggcuacgacguggagaacgaggagaaggugaagcugggcaugaccaacagccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4223 - RNA, 2534 nt, Artificial Sequence
  mRNA product Design3 comprising derived and/or modified sequence from Homo sapiens__NP_000592.3__HsHGF (opt4)
gggagagucccgcagucggcguccagcggcucugcuuguucgugugugugucguugcaggccuuauucaagcuuaccaugugggugaccaagcugcugcccgcccugcugcugcagcacgugcugcugcaccugcugcugcugcccaucgccauccccuacgccgagggccagagaaagagaagaaacaccauccacgaguucaagaagagcgccaagaccacccugaucaagaucgaccccgcccugaagaucaagaccaagaaggugaacaccgccgaccagugcgccaacagaugcaccagaaacaagggccugcccuucaccugcaaggccuucguguucgacaaggccagaaagcagugccugugguuccccuucaacagcaugagcagcggcgugaagaaggaguucggccacgaguucgaccuguacgagaacaaggacuacaucagaaacugcaucaucggcaagggcagaagcuacaagggcaccgugagcaucaccaagagcggcaucaagugccagcccuggagcagcaugaucccccacgagcacagcuuccugcccagcagcuacagaggcaaggaccugcaggagaacuacugcagaaaccccagaggcgaggagggcggccccuggugcuucaccagcaaccccgaggugagauacgaggugugcgacaucccccagugcagcgagguggagugcaugaccugcaacggcgagagcuacagaggccugauggaccacaccgagagcggcaagaucugccagagaugggaccaccagaccccccacagacacaaguuccugcccgagagauaccccgacaagggcuucgacgacaacuacugcagaaaccccgacggccagcccagacccuggugcuacacccuggacccccacaccagaugggaguacugcgccaucaagaccugcgccgacaacaccaugaacgacaccgacgugccccuggagaccaccgagugcauccagggccagggcgagggcuacagaggcaccgugaacaccaucuggaacggcauccccugccagagaugggacagccaguacccccacgagcacgacaugacccccgagaacuucaagugcaaggaccugagagagaacuacugcagaaaccccgacggcagcgagagccccuggugcuucaccaccgaccccaacaucagagugggcuacugcagccagauccccaacugcgacaugagccacggccaggacugcuacagaggcaacggcaagaacuacaugggcaaccugagccagaccagaagcggccugaccugcagcaugugggacaagaacauggaggaccugcacagacacaucuucugggagcccgacgccagcaagcugaacgagaacuacugcagaaaccccgacgacgacgcccacggccccuggugcuacaccggcaacccccugauccccugggacuacugccccaucagcagaugcgagggcgacaccacccccaccaucgugaaccuggaccaccccgugaucagcugcgccaagaccaagcagcugagaguggugaacggcauccccaccagaaccaacaucggcuggauggugagccugagauacagaaacaagcacaucugcggcggcagccugaucaaggagagcugggugcugaccgccagacagugcuuccccagcagagaccugaaggacuacgaggccuggcugggcauccacgacgugcacggcagaggcgacgagaagugcaagcaggugcugaacgugagccagcugguguacggccccgagggcagcgaccuggugcugaugaagcuggccagacccgccgugcuggacgacuucgugagcaccaucgaccugcccaacuacggcugcaccauccccgagaagaccagcugcagcguguacggcuggggcuacaccggccugaucaacuacgacggccugcugagaguggcccaccuguacaucaugggcaacgagaagugcagccagcaccacagaggcaaggugacccugaacgagagcgagaucugcgccggcgccgagaagaucggcagcggccccugcgagggcgacuacggcggcccccuggugugcgagcagcacaagaugagaauggugcugggcgugaucgugcccggcagaggcugcgccauccccaacagacccggcaucuucgugagaguggccuacuacgccaaguggauccacaagaucauccugaccuacaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4224 - RNA, 2273 nt, Artificial Sequence
  mRNA product Design3 comprising derived and/or modified sequence from Homo sapiens__NP_005336.3 __HsHSPA1A (opt4)
gggagagucccgcagucggcguccagcggcucugcuuguucgugugugugucguugcaggccuuauucaagcuuaccauggccaaggccgccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggcccugaacccccagaacaccguguucgacgccaagagacugaucggcagaaaguucggcgaccccguggugcagagcgacaugaagcacuggcccuuccaggugaucaacgacggcgacaagcccaaggugcaggugagcuacaagggcgagaccaaggccuucuaccccgaggagaucagcagcauggugcugaccaagaugaaggagaucgccgaggccuaccugggcuaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacagaaccggcaagggcgagagaaacgugcugaucuucgaccugggcggcggcaccuucgacgugagcauccugaccaucgacgacggcaucuucgaggugaaggccaccgccggcgacacccaccugggcggcgaggacuucgacaacagacuggugaaccacuucguggaggaguucaagagaaagcacaagaaggacaucagccagaacaagagagccgugagaagacugagaaccgccugcgagagagccaagagaacccugagcagcagcacccaggccagccuggagaucgacagccuguucgagggcaucgacuucuacaccagcaucaccagagccagauucgaggagcugugcagcgaccuguucagaagcacccuggagcccguggagaaggcccugagagacgccaagcuggacaaggcccagauccacgaccuggugcuggugggcggcagcaccagaauccccaaggugcagaagcugcugcaggacuucuucaacggcagagaccugaacaagagcaucaaccccgacgaggccguggccuacggcgccgccgugcaggccgccauccugaugggcgacaagagcgagaacgugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgagcugagcggcaucccccccgcccccagaggcgugccccagaucgaggugaccuucgacaucgacgccaacggcauccugaacgugaccgccaccgacaagagcaccggcaaggccaacaagaucaccaucaccaacgacaagggcagacugagcaaggaggagaucgagagaauggugcaggaggccgagaaguacaaggccgaggacgaggugcagagagagagagugagcgccaagaacgcccuggagagcuacgccuucaacaugaagagcgccguggaggacgagggccugaagggcaagaucagcgaggccgacaagaagaaggugcuggacaagugccaggaggugaucagcuggcuggacgccaacacccuggccgagaaggacgaguucgagcacaagagaaaggagcuggagcaggugugcaaccccaucaucagcggccuguaccagggcgccggcggccccggccccggcggcuucggcgcccagggccccaagggcggcagcggcagcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4225 - RNA, 2273 nt, Artificial Sequence; identical to SEQ ID NO: 4224
  mRNA product Design3 comprising derived and/or modified sequence from Homo sapiens__NP_005337.2 __HsHSPA1B (opt4)

SEQ ID NO: 4226 - RNA, 2273 nt, Artificial Sequence
  mRNA product Design3 comprising derived and/or modified sequence from Homo sapiens__NP_005518.3 __HsHSPA1L (opt4)
gggagagucccgcagucggcguccagcggcucugcuuguucgugugugugucguugcaggccuuauucaagcuuaccauggccaccgccaagggcaucgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaacccccagaacaccguguucgacgccaagagacugaucggcagaaaguucaacgaccccguggugcaggccgacaugaagcuguggcccuuccaggugaucaacgagggcggcaagcccaaggugcuggugagcuacaagggcgagaacaaggccuucuaccccgaggagaucagcagcauggugcugaccaagcugaaggagaccgccgaggccuuccugggccaccccgugaccaacgccgugaucaccgugcccgccuacuucaacgacagccagagacaggccaccaaggacgccggcgugaucgccggccugaacgugcugagaaucaucaacgagcccaccgccgccgccaucgccuacggccuggacaagggcggccagggcgagagacacgugcugaucuucgaccugggcggcggcaccuucgacgugagcauccugaccaucgacgacggcaucuucgaggugaaggccaccgccggcgacacccaccugggcggcgaggacuucgacaacagacuggugagccacuucguggaggaguucaagagaaagcacaagaaggacaucagccagaacaagagagccgugagaagacugagaaccgccugcgagagagccaagagaacccugagcagcagcacccaggccaaccuggagaucgacagccuguacgagggcaucgacuucuacaccagcaucaccagagccagauucgaggagcugugcgccgaccuguucagaggcacccuggagcccguggagaaggcccugagagacgccaagauggacaaggccaagauccacgacaucgugcuggugggcggcagcaccagaauccccaaggugcagagacugcugcaggacuacuucaacggcagagaccugaacaagagcaucaaccccgacgaggccguggccuacggcgccgccgugcaggccgccauccugaugggcgacaagagcgagaaggugcaggaccugcugcugcuggacguggccccccugagccugggccuggagaccgccggcggcgugaugaccgcccugaucaagagaaacagcaccauccccaccaagcagacccagaucuucaccaccuacagcgacaaccagcccggcgugcugauccagguguacgagggcgagagagccaugaccaaggacaacaaccugcugggcagauucgaccugaccggcaucccccccgcccccagaggcgugccccagaucgaggugaccuucgacaucgacgccaacggcauccugaacgugaccgccaccgacaagagcaccggcaaggugaacaagaucaccaucaccaacgacaagggcagacugagcaaggaggagaucgagagaauggugcuggacgccgagaaguacaaggccgaggacgaggugcagagagagaagaucgccgccaagaacgcccuggagagcuacgccuucaacaugaagagcguggugagcgacgagggccugaagggcaagaucagcgagagcgacaagaacaagauccuggacaagugcaacgagcugcugagcuggcuggaggugaaccagcuggccgagaaggacgaguucgaccacaagagaaaggagcuggagcagaugugcaaccccaucaucaccaagcuguaccagggcggcugcaccggccccgccugcggcaccggcuacgugcccggcagacccgccaccggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4227 - RNA, 2267 nt, Artificial Sequence
  mRNA product Design3 comprising derived and/or modified sequence from Homo sapiens__NP_068814.2 __HsHSPA2 (opt4)
gggagagucccgcagucggcguccagcggcucugcuuguucgugugugugucguugcaggccuuauucaagcuuaccaugagcgccagaggccccgccaucggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccaucuucgacgccaagagacugaucggcagaaaguucgaggacgccaccgugcagagcgacaugaagcacuggcccuucagaguggugagcgagggcggcaagcccaaggugcagguggaguacaagggcgagaccaagaccuucuuccccgaggagaucagcagcauggugcugaccaagaugaaggagaucgccgaggccuaccugggcggcaaggugcacagcgccgugaucaccgugcccgccuacuucaacgacagccagagacaggccaccaaggacgccggcaccaucaccggccugaacgugcugagaaucaucaacgagcccaccgccgccgccaucgccuacggccuggacaagaagggcugcgccggcggcgagaagaacgugcugaucuucgaccugggcggcggcaccuucgacgugagcauccugaccaucgaggacggcaucuucgaggugaagagcaccgccggcgacacccaccugggcggcgaggacuucgacaacagaauggugagccaccuggccgaggaguucaagagaaagcacaagaaggacaucggccccaacaagagagccgugagaagacugagaaccgccugcgagagagccaagagaacccugagcagcagcacccaggccagcaucgagaucgacagccuguacgagggcguggacuucuacaccagcaucaccagagccagauucgaggagcugaacgccgaccuguucagaggcacccuggagcccguggagaaggcccugagagacgccaagcuggacaagggccagauccaggagaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugaucggcgacaagagcgagaacgugcaggaccugcugcugcuggacgugaccccccugagccugggcaucgagaccgccggcggcgugaugaccccccugaucaagagaaacaccaccauccccaccaagcagacccagaccuucaccaccuacagcgacaaccagagcagcgugcuggugcagguguacgagggcgagagagccaugaccaaggacaacaaccugcugggcaaguucgaccugaccggcaucccccccgcccccagaggcgugccccagaucgaggugaccuucgacaucgacgccaacggcauccugaacgugaccgccgccgacaagagcaccggcaaggagaacaagaucaccaucaccaacgacaagggcagacugagcaaggacgacaucgacagaauggugcaggaggccgagagauacaagagcgaggacgaggccaacagagacagaguggccgccaagaacgcccuggagagcuacaccuacaacaucaagcagaccguggaggacgagaagcugagaggcaagaucagcgagcaggacaagaacaagauccuggacaagugccaggaggugaucaacuggcuggacagaaaccagauggccgagaaggacgaguacgagcacaagcagaaggagcuggagagagugugcaaccccaucaucagcaagcuguaccagggcggccccggcggcggcagcggcggcggcggcagcggcgccagcggcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4228 - RNA, 2870 nt, Artificial Sequence
  mRNA product Design3 comprising derived and/or modified sequence from Homo sapiens__NP_002145.3 __HsHSPA4 (opt4)
gggagagucccgcagucggcguccagcggcucugcuuguucgugugugugucguugcaggccuuauucaagcuuaccaugagcguggugggcaucgaccugggcuuccagagcugcuacguggccguggccagagccggcggcaucgagaccaucgccaacgaguacagcgacagaugcacccccgccugcaucagcuucggccccaagaacagaagcaucggcgccgccgccaagagccaggugaucagcaacgccaagaacaccgugcagggcuucaagagauuccacggcagagccuucagcgaccccuucguggaggccgagaagagcaaccuggccuacgacaucgugcagcugcccaccggccugaccggcaucaaggugaccuacauggaggaggagagaaacuucaccaccgagcaggugaccgccaugcugcugagcaagcugaaggagaccgccgagagcgugcugaagaagcccgugguggacugcguggugagcgugcccugcuucuacaccgacgccgagagaagaagcgugauggacgccacccagaucgccggccugaacugccugagacugaugaacgagaccaccgccguggcccuggccuacggcaucuacaagcaggaccugcccgcccuggaggagaagcccagaaacgugguguucguggacaugggccacagcgccuaccaggugagcgugugcgccuucaacagaggcaagcugaaggugcuggccaccgccuucgacaccacccugggcggcagaaaguucgacgaggugcuggugaaccacuucugcgaggaguucggcaagaaguacaagcuggacaucaagagcaagaucagagcccugcugagacugagccaggagugcgagaagcugaagaagcugaugagcgccaacgccagcgaccugccccugagcaucgagugcuucaugaacgacguggacgugagcggcaccaugaacagaggcaaguuccuggagaugugcaacgaccugcuggccagaguggagcccccccugagaagcgugcuggagcagaccaagcugaagaaggaggacaucuacgccguggagaucgugggcggcgccaccagaauccccgccgugaaggagaagaucagcaaguucuucggcaaggagcugagcaccacccugaacgccgacgaggccgugaccagaggcugcgcccugcagugcgccauccugagccccgccuucaaggugagagaguucagcaucaccgacguggugcccuaccccaucagccugagauggaacagccccgccgaggagggcagcagcgacugcgagguguucagcaagaaccacgccgcccccuucagcaaggugcugaccuucuacagaaaggagcccuucacccuggaggccuacuacagcagcccccaggaccugcccuaccccgaccccgccaucgcccaguucagcgugcagaaggugaccccccagagcgacggcagcagcagcaaggugaaggugaaggugagagugaacgugcacggcaucuucagcgugagcagcgccagccugguggaggugcacaagagcgaggagaacgaggagcccauggagaccgaccagaacgccaaggaggaggagaagaugcagguggaccaggaggagccccacguggaggagcagcagcagcagacccccgccgagaacaaggccgagagcgaggagauggagaccagccaggccggcagcaaggacaagaagauggaccagcccccccaggccaagaaggccaaggugaagaccagcaccguggaccugcccaucgagaaccagcugcuguggcagaucgacagagagaugcugaaccuguacaucgagaacgagggcaagaugaucaugcaggacaagcuggagaaggagagaaacgacgccaagaacgccguggaggaguacguguacgagaugagagacaagcugagcggcgaguacgagaaguucgugagcgaggacgacagaaacagcuucacccugaagcuggaggacaccgagaacuggcuguacgaggacggcgaggaccagcccaagcagguguacguggacaagcuggccgagcugaagaaccugggccagcccaucaagaucagauuccaggagagcgaggagagacccaagcuguucgaggagcugggcaagcagauccagcaguacaugaagaucaucagcagcuucaagaacaaggaggaccaguacgaccaccuggacgccgccgacaugaccaagguggagaagagcaccaacgaggccauggaguggaugaacaacaagcugaaccugcagaacaagcagagccugaccauggaccccguggugaagagcaaggagaucgaggccaagaucaaggagcugaccagcaccugcagccccaucaucagcaagcccaagcccaagguggagccccccaaggaggagcagaagaacgccgagcagaacggccccguggacggccagggcgacaaccccggcccccaggccgccgagcagggcaccgacaccgccgugcccagcgacagcgacaagaagcugcccgagauggacaucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4229 - RNA, 2867 nt, Artificial Sequence
  mRNA product Design3 comprising derived and/or modified sequence from Homo sapiens__NP_055093.2 __HsHSPA4L (opt4)
gggagagucccgcagucggcguccagcggcucugcuuguucgugugugugucguugcaggccuuauucaagcuuaccaugagcguggugggcaucgaccugggcuuccugaacugcuacaucgccguggccagaagcggcggcaucgagaccaucgccaacgaguacagcgacagaugcacccccgccugcaucagccugggcagcagaaccagagccaucggcaacgccgccaagagccagaucgugaccaacgugagaaacaccauccacggcuucaagaagcugcacggcagaagcuucgacgaccccaucgugcagaccgagagaaucagacugcccuacgagcugcagaagaugcccaacggcagcgccggcgugaaggugagauaccuggaggaggagagacccuucgccaucgagcaggugaccggcaugcugcuggccaagcugaaggagaccagcgagaacgcccugaagaagcccguggccgacugcgugaucagcauccccagcuucuucaccgacgccgagagaagaagcgugauggccgccgcccagguggccggccugaacugccugagacugaugaacgagaccaccgccguggcccuggccuacggcaucuacaagcaggaccugcccccccuggacgagaagcccagaaacgugguguucaucgacaugggccacagcgccuaccaggugcuggugugcgccuucaacaagggcaagcugaaggugcuggccaccaccuucgaccccuaccugggcggcagaaacuucgacgaggcccugguggacuacuucugcgacgaguucaagaccaaguacaagaucaacgugaaggagaacagcagagcccugcugagacuguaccaggagugcgagaagcugaagaagcugaugagcgccaacgccagcgaccugccccugaacaucgagugcuucaugaacgaccuggacgugagcagcaagaugaacagagcccaguucgagcagcugugcgccagccugcuggccagaguggagcccccccugaaggccgugauggagcaggccaaccugcagagagaggacaucagcagcaucgagaucgugggcggcgccaccagaauccccgccgugaaggagcagaucaccaaguucuuccugaaggacaucagcaccacccugaacgccgacgaggccguggccagaggcugcgcccugcagugcgccauccugagccccgccuucaaggugagagaguucagcaucaccgaccuggugcccuacagcaucacccugagauggaagaccagcuucgaggacggcagcggcgagugcgagguguucugcaagaaccaccccgcccccuucagcaaggugaucaccuuccacaagaaggagcccuucgagcuggaggccuucuacaccaaccugcacgaggugcccuaccccgacgccagaaucggcagcuucaccauccagaacguguucccccagagcgacggcgacagcagcaaggugaaggugaaggugagagugaacauccacggcaucuucagcguggccagcgccagcgugaucgagaagcagaaccuggagggcgaccacagcgacgcccccauggagaccgagaccagcuucaagaacgagaacaaggacaacauggacaagaugcagguggaccaggaggagggccaccagaagugccacgccgagcacacccccgaggaggagaucgaccacaccggcgccaagaccaagagcgccgugagcgacaagcaggacagacugaaccagacccugaagaagggcaaggugaagagcaucgaccugcccauccagagcagccugugcagacagcugggccaggaccugcugaacagcuacaucgagaacgagggcaagaugaucaugcaggacaagcuggagaaggagagaaacgacgccaagaacgccguggaggaguacguguacgacuucagagacagacugggcaccguguacgagaaguucaucacccccgaggaccugagcaagcugagcgccgugcuggaggacaccgagaacuggcuguacgaggacggcgaggaccagcccaagcagguguacguggacaagcugcaggagcugaagaaguacggccagcccauccagaugaaguacauggagcacgaggagagacccaaggcccugaacgaccugggcaagaagauccagcuggugaugaaggugaucgaggccuacagaaacaaggacgagagauacgaccaccuggaccccaccgagauggagaagguggagaagugcaucagcgacgccaugagcuggcugaacagcaagaugaacgcccagaacaagcugagccugacccaggaccccguggugaaggugagcgagaucguggccaagagcaaggagcuggacaacuucugcaaccccaucaucuacaagcccaagcccaaggccgaggugcccgaggacaagcccaaggccaacagcgagcacaacggccccauggacggccagagcggcaccgagaccaagagcgacagcaccaaggacagcagccagcacaccaagagcagcggcgagauggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4230 - RNA, 2312 nt, Artificial Sequence
  mRNA product Design3 comprising derived and/or modified sequence from Homo sapiens__NP_005338.1__HsHSPA5 (opt4)
gggagagucccgcagucggcguccagcggcucugcuuguucgugugugugucguugcaggccuuauucaagcuuaccaugaagcugagccugguggccgccaugcugcugcugcugagcgccgccagagccgaggaggaggacaagaaggaggacgugggcaccguggugggcaucgaccugggcaccaccuacagcugcgugggcguguucaagaacggcagaguggagaucaucgccaacgaccagggcaacagaaucacccccagcuacguggccuucacccccgagggcgagagacugaucggcgacgccgccaagaaccagcugaccagcaaccccgagaacaccguguucgacgccaagagacugaucggcagaaccuggaacgaccccagcgugcagcaggacaucaaguuccugcccuucaaggugguggagaagaagaccaagcccuacauccagguggacaucggcggcggccagaccaagaccuucgcccccgaggagaucagcgccauggugcugaccaagaugaaggagaccgccgaggccuaccugggcaagaaggugacccacgccguggugaccgugcccgccuacuucaacgacgcccagagacaggccaccaaggacgccggcaccaucgccggccugaacgugaugagaaucaucaacgagcccaccgccgccgccaucgccuacggccuggacaagagagagggcgagaagaacauccugguguucgaccugggcggcggcaccuucgacgugagccugcugaccaucgacaacggcguguucgaggugguggccaccaacggcgacacccaccugggcggcgaggacuucgaccagagagugauggagcacuucaucaagcuguacaagaagaagaccggcaaggacgugagaaaggacaacagagccgugcagaagcugagaagagagguggagaaggccaagagagcccugagcagccagcaccaggccagaaucgagaucgagagcuucuacgagggcgaggacuucagcgagacccugaccagagccaaguucgaggagcugaacauggaccuguucagaagcaccaugaagcccgugcagaaggugcuggaggacagcgaccugaagaagagcgacaucgacgagaucgugcuggugggcggcagcaccagaauccccaagauccagcagcuggugaaggaguucuucaacggcaaggagcccagcagaggcaucaaccccgacgaggccguggccuacggcgccgccgugcaggccggcgugcugagcggcgaccaggacaccggcgaccuggugcugcuggacgugugcccccugacccugggcaucgagaccgugggcggcgugaugaccaagcugauccccagaaacaccguggugcccaccaagaagagccagaucuucagcaccgccagcgacaaccagcccaccgugaccaucaagguguacgagggcgagagaccccugaccaaggacaaccaccugcugggcaccuucgaccugaccggcaucccccccgcccccagaggcgugccccagaucgaggugaccuucgagaucgacgugaacggcauccugagagugaccgccgaggacaagggcaccggcaacaagaacaagaucaccaucaccaacgaccagaacagacugacccccgaggagaucgagagaauggugaacgacgccgagaaguucgccgaggaggacaagaagcugaaggagagaaucgacaccagaaacgagcuggagagcuacgccuacagccugaagaaccagaucggcgacaaggagaagcugggcggcaagcugagcagcgaggacaaggagaccauggagaaggccguggaggagaagaucgaguggcuggagagccaccaggacgccgacaucgaggacuucaaggccaagaagaaggagcuggaggagaucgugcagcccaucaucagcaagcuguacggcagcgccggccccccccccaccggcgaggaggacaccgccgagaaggacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4231 - RNA, 2279 nt, Artificial Sequence
  mRNA product Design3 comprising derived and/or modified sequence from Homo sapiens__NP_002146.2__HsHSPA6 (opt4)
gggagagucccgcagucggcguccagcggcucugcuuguucgugugugugucguugcaggccuuauucaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuucagaguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccgccuacuucaacgacagccagagacaggccaccaaggacgccggcgccaucgccggccugaacgugcugagaaucaucaacgagcccaccgccgccgccaucgccuacggccuggacagaagaggcgccggcgagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccugagcagcagcacccaggccacccuggagaucgacagccuguucgagggcguggacuucuacaccagcaucaccagagccagauucgaggagcugugcagcgaccuguucagaagcacccuggagcccguggagaaggcccugagagacgccaagcuggacaaggcccagauccacgacguggugcuggugggcggcagcaccagaauccccaaggugcagaagcugcugcaggacuucuucaacggcaaggagcugaacaagagcaucaaccccgacgaggccguggccuacggcgccgccgugcaggccgccgugcugaugggcgacaagugcgagaaggugcaggaccugcugcugcuggacguggccccccugagccugggccuggagaccgccggcggcgugaugaccacccugauccagagaaacgccaccauccccaccaagcagacccagaccuucaccaccuacagcgacaaccagcccggcguguucauccagguguacgagggcgagagagccaugaccaaggacaacaaccugcugggcagauucgagcugagcggcaucccccccgcccccagaggcgugccccagaucgaggugaccuucgacaucgacgccaacggcauccugagcgugaccgccaccgacagaagcaccggcaaggccaacaagaucaccaucaccaacgacaagggcagacugagcaaggaggagguggagagaauggugcacgaggccgagcaguacaaggccgaggacgaggcccagagagacagaguggccgccaagaacagccuggaggcccacguguuccacgugaagggcagccugcaggaggagagccugagagacaagauccccgaggaggacagaagaaagaugcaggacaagugcagagaggugcuggccuggcuggagcacaaccagcuggccgagaaggaggaguacgagcaccagaagagagagcuggagcagaucugcagacccaucuucagcagacuguacggcggccccggcgugcccggcggcagcagcugcggcacccaggccagacagggcgaccccagcaccggccccaucaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4232 - RNA, 1451 nt, Artificial Sequence
  mRNA product Design3 comprising derived and/or modified sequence from Homo sapiens__P48741__HsHSPA7 (opt4)
gggagagucccgcagucggcguccagcggcucugcuuguucgugugugugucguugcaggccuuauucaagcuuaccaugcaggcccccagagagcuggccgugggcaucgaccugggcaccaccuacagcugcgugggcguguuccagcagggcagaguggagauccuggccaacgaccagggcaacagaaccacccccagcuacguggccuucaccgacaccgagagacuggugggcgacgccgccaagagccaggccgcccugaacccccacaacaccguguucgacgccaagagacugaucggcagaaaguucgccgacaccaccgugcagagcgacaugaagcacuggcccuuccagguggugagcgagggcggcaagcccaaggugagagugugcuacagaggcgaggacaagaccuucuaccccgaggagaucagcagcauggugcugagcaagaugaaggagaccgccgaggccuaccugggccagcccgugaagcacgccgugaucaccgugcccaccuacuucagcaacagccagagacaggccaccaaggacgccggcgccaucgccggccugaaggugcugcccaucaucaacgaggccaccgccgccgccaucgccuacggccuggacagaagaggcgccggcaagagaaacgugcugaucuucgaccugggcggcggcaccuucgacgugagcgugcugagcaucgacgccggcguguucgaggugaaggccaccgccggcgacacccaccugggcggcgaggacuucgacaacagacuggugaaccacuucauggaggaguucagaagaaagcacggcaaggaccugagcggcaacaagagagcccugagaagacugagaaccgccugcgagagagccaagagaacccccagcagcagcacccaggccacccuggagaucgacagccuguucgagggcguggacuucuacaagagcaucaccagagccagauucgaggagcugugcagcgaccuguucagaagcacccuggagcccguggagaaggcccugagagacgccaagcuggacaaggcccagauccacgacuucgugcugggcggcggccugcacagccacccccagggcgccgagguggccgccggccugcugcagagacagggcgccgagcaggagcaccagcccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4233 - RNA, 2288 nt, Artificial Sequence
  mRNA product Design3 comprising derived and/or modified sequence from Homo sapiens__NP_006588.1 __HsHSPA8 (opt4)
gggagagucccgcagucggcguccagcggcucugcuuguucgugugugugucguugcaggccuuauucaagcuuaccaugagcaagggccccgccgugggcaucgaccugggcaccaccuacagcugcgugggcguguuccagcacggcaagguggagaucaucgccaacgaccagggcaacagaaccacccccagcuacguggccuucaccgacaccgagagacugaucggcgacgccgccaagaaccagguggccaugaaccccaccaacaccguguucgacgccaagagacugaucggcagaagauucgacgacgccguggugcagagcgacaugaagcacuggcccuucaugguggugaacgacgccggcagacccaaggugcagguggaguacaagggcgagaccaagagcuucuaccccgaggaggugagcagcauggugcugaccaagaugaaggagaucgccgaggccuaccugggcaagaccgugaccaacgccguggugaccgugcccgccuacuucaacgacagccagagacaggccaccaaggacgccggcaccaucgccggccugaacgugcugagaaucaucaacgagcccaccgccgccgccaucgccuacggccuggacaagaaggugggcgccgagagaaacgugcugaucuucgaccugggcggcggcaccuucgacgugagcauccugaccaucgaggacggcaucuucgaggugaagagcaccgccggcgacacccaccugggcggcgaggacuucgacaacagaauggugaaccacuucaucgccgaguucaagagaaagcacaagaaggacaucagcgagaacaagagagccgugagaagacugagaaccgccugcgagagagccaagagaacccugagcagcagcacccaggccagcaucgagaucgacagccuguacgagggcaucgacuucuacaccagcaucaccagagccagauucgaggagcugaacgccgaccuguucagaggcacccuggaccccguggagaaggcccugagagacgccaagcuggacaagagccagauccacgacaucgugcuggugggcggcagcaccagaauccccaagauccagaagcugcugcaggacuucuucaacggcaaggagcugaacaagagcaucaaccccgacgaggccguggccuacggcgccgccgugcaggccgccauccugagcggcgacaagagcgagaacgugcaggaccugcugcugcuggacgugaccccccugagccugggcaucgagaccgccggcggcgugaugaccgugcugaucaagagaaacaccaccauccccaccaagcagacccagaccuucaccaccuacagcgacaaccagcccggcgugcugauccagguguacgagggcgagagagccaugaccaaggacaacaaccugcugggcaaguucgagcugaccggcaucccccccgcccccagaggcgugccccagaucgaggugaccuucgacaucgacgccaacggcauccugaacgugagcgccguggacaagagcaccggcaaggagaacaagaucaccaucaccaacgacaagggcagacugagcaaggaggacaucgagagaauggugcaggaggccgagaaguacaaggccgaggacgagaagcagagagacaaggugagcagcaagaacagccuggagagcuacgccuucaacaugaaggccaccguggaggacgagaagcugcagggcaagaucaacgacgaggacaagcagaagauccuggacaagugcaacgagaucaucaacuggcuggacaagaaccagaccgccgagaaggaggaguucgagcaccagcagaaggagcuggagaaggugugcaaccccaucaucaccaagcuguaccagagcgccggcggcaugcccggcggcaugcccggcggcuuccccggcggcggcgccccccccagcggcggcgccagcagcggccccaccaucgaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4234 - RNA, 2387 nt, Artificial Sequence
  mRNA product Design3 comprising derived and/or modified sequence from Homo sapiens__NP_004125.3 __HsHSPA9 (opt4)
gggagagucccgcagucggcguccagcggcucugcuuguucgugugugugucguugcaggccuuauucaagcuuaccaugaucagcgccagcagagccgccgccgccagacuggugggcgccgccgccagcagaggccccaccgccgccagacaccaggacagcuggaacggccugagccacgaggccuucagacuggugagcagaagagacuacgccagcgaggccaucaagggcgccguggugggcaucgaccugggcaccaccaacagcugcguggccgugauggagggcaagcaggccaaggugcuggagaacgccgagggcgccagaaccacccccagcgugguggccuucaccgccgacggcgagagacuggugggcaugcccgccaagagacaggccgugaccaaccccaacaacaccuucuacgccaccaagagacugaucggcagaagauacgacgaccccgaggugcagaaggacaucaagaacgugcccuucaagaucgugagagccagcaacggcgacgccuggguggaggcccacggcaagcuguacagccccagccagaucggcgccuucgugcugaugaagaugaaggagaccgccgagaacuaccugggccacaccgccaagaacgccgugaucaccgugcccgccuacuucaacgacagccagagacaggccaccaaggacgccggccagaucagcggccugaacgugcugagagugaucaacgagcccaccgccgccgcccuggccuacggccuggacaagagcgaggacaaggugaucgccguguacgaccugggcggcggcaccuucgacaucagcauccuggagauccagaagggcguguucgaggugaagagcaccaacggcgacaccuuccugggcggcgaggacuucgaccaggcccugcugagacacaucgugaaggaguucaagagagagaccggcguggaccugaccaaggacaacauggcccugcagagagugagagaggccgccgagaaggccaagugcgagcugagcagcagcgugcagaccgacaucaaccugcccuaccugaccauggacagcagcggccccaagcaccugaacaugaagcugaccagagcccaguucgagggcaucgugaccgaccugaucagaagaaccaucgcccccugccagaaggccaugcaggacgccgaggugagcaagagcgacaucggcgaggugauccuggugggcggcaugaccagaaugcccaaggugcagcagaccgugcaggaccuguucggcagagcccccagcaaggccgugaaccccgacgaggccguggccaucggcgccgccauccagggcggcgugcuggccggcgacgugaccgacgugcugcugcuggacgugaccccccugagccugggcaucgagacccugggcggcguguucaccaagcugaucaacagaaacaccaccauccccaccaagaagagccagguguucagcaccgccgccgacggccagacccagguggagaucaaggugugccagggcgagagagagauggccggcgacaacaagcugcugggccaguucacccugaucggcaucccccccgcccccagaggcgugccccagaucgaggugaccuucgacaucgacgccaacggcaucgugcacgugagcgccaaggacaagggcaccggcagagagcagcagaucgugauccagagcagcggcggccugagcaaggacgacaucgagaacauggugaagaacgccgagaaguacgccgaggaggacagaagaaagaaggagagaguggaggccgugaacauggccgagggcaucauccacgacaccgagaccaagauggaggaguucaaggaccagcugcccgccgacgagugcaacaagcugaaggaggagaucagcaagaugagagagcugcuggccagaaaggacagcgagaccggcgagaacaucagacaggccgccagcagccugcagcaggccagccugaagcuguucgagauggccuacaagaagauggccagcgagagagagggcagcggcagcagcggcaccggcgagcagaaggaggaccagaaggaggagaagcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4235 - RNA, 2375 nt, Artificial Sequence
  mRNA product Design3 comprising derived and/or modified sequence from Homo sapiens__NP_079291.2__HsHSPA12A (opt4)
gggagagucccgcagucggcguccagcggcucugcuuguucgugugugugucguugcaggccuuauucaagcuuaccauggccgacaaggaggccggcggcagcgacggccccagagagaccgcccccaccagcgccuacagcagccccgccagaagccugggcgacaccggcaucaccccccugagccccagccacaucgugaacgacaccgacagcaacgugagcgagcagcagagcuuccugguggugguggccguggacuucggcaccaccagcagcggcuacgccuacagcuucaccaaggagcccgagugcauccacgugaugagaagaugggagggcggcgaccccggcgugagcaaccagaagacccccaccaccauccugcugacccccgagagaaaguuccacagcuucggcuacgccgccagagacuucuaccacgaccuggaccccaacgaggccaagcaguggcuguaccuggagaaguucaagaugaagcugcacaccaccggcgaccugaccauggacaccgaccugaccgccgccaacggcaagaaggugaaggcccuggagaucuucgccuacgcccugcaguacuucaaggagcaggcccugaaggagcugagcgaccaggccggcagcgaguucgagaacagcgacgugagaugggugaucaccgugcccgccaucuggaagcagcccgccaagcaguucaugagacaggccgccuaccaggccggccuggccagccccgagaacagcgagcagcugaucaucgcccuggagcccgaggccgccagcaucuacugcagaaagcugagacugcaccagaugaucgagcugagcagcaaggccgccgugaacggcuacagcggcagcgacaccgugggcgccggcuucacccaggccaaggagcacaucagaagaaacagacagagcagaaccuuccugguggagaacgugaucggcgagaucuggagcgagcuggaggagggcgacaaguacguggugguggacagcggcggcggcaccguggaccugaccgugcaccagaucagacugcccgagggccaccugaaggagcuguacaaggccaccggcggccccuacggcagccugggcguggacuacgaguucgagaagcugcuguacaagaucuucggcgaggacuucaucgagcaguucaagaucaagagacccgccgccuggguggaccugaugaucgccuucgagagcagaaagagagccgccgcccccgacagaaccaacccccugaacaucacccugcccuucagcuucaucgacuacuacaagaaguucagaggccacagcguggagcacgcccugagaaagagcaacguggacuucgugaaguggagcagccagggcaugcugagaaugagccccgacgccaugaacgcccuguucaagcccaccaucgacagcaucaucgagcaccugagagaccuguuccagaagcccgaggugagcaccgugaaguuccuguuccuggugggcggcuucgccgaggccccccugcugcagcaggccgugcaggccgccuucggcgaccagugcagaaucaucaucccccaggacgugggccugaccauccugaagggcgccgugcuguucggccuggaccccgccgugaucaaggugagaagaagcccccugaccuacggcgugggcgugcugaacagauacguggagggcaagcacccccccgagaagcugcuggugaaggacggcaccagauggugcaccgacguguucgacaaguucaucagcgccgaccagagcguggcccugggcgagcuggugaagagaagcuacacccccgccaagcccagccagcuggugaucgugaucaacaucuacagcagcgagcacgacaacgugagcuucaucaccgaccccggcgugaagaagugcggcacccugagacuggaccugaccggcaccagcggcaccgccgugcccgccagaagagagauccagacccugaugcaguucggcgacaccgagaucaaggccaccgccaucgacaucgccaccagcaagagcgugaaggugggcaucgacuuccugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4236 - RNA, 2408 nt, Artificial Sequence
  mRNA product Design3 comprising derived and/or modified sequence from Homo sapiens__NP_443202.3 __HsHSPA12B (opt4)
gggagagucccgcagucggcguccagcggcucugcuuguucgugugugugucguugcaggccuuauucaagcuuaccaugcuggccgugcccgagaugggccugcagggccuguacaucggcagcagccccgagagaagccccgugcccagcccccccggcagccccagaacccaggagagcugcggcaucgccccccugacccccagccagagccccaagcccgaggugagagccccccagcaggccagcuucagcguggugguggccaucgacuucggcaccaccagcagcggcuacgccuucagcuucgccagcgaccccgaggccauccacaugaugagaaagugggagggcggcgaccccggcguggcccaccagaagacccccaccugccugcugcugacccccgagggcgccuuccacagcuucggcuacaccgccagagacuacuaccacgaccuggaccccgaggaggccagagacuggcuguacuucgagaaguucaagaugaagauccacagcgccaccgaccugacccugaagacccagcuggaggccgugaacggcaagaccaugcccgcccuggagguguucgcccacgcccugagauucuucagagagcacgcccugcaggagcugagagagcagagccccagccugcccgagaaggacaccgugagaugggugcugaccgugcccgccaucuggaagcagcccgccaagcaguucaugagagaggccgccuaccuggccggccuggugagcagagagaacgccgagcagcugcugaucgcccuggagcccgaggccgccagcguguacugcagaaagcugagacugcaccagcugcuggaccugagcggcagagcccccggcggcggcagacugggcgagagaagaagcaucgacagcagcuucagacaggccagagagcagcugagaagaagcagacacagcagaaccuuccugguggagagcggcgugggcgagcugugggccgagaugcaggccggcgacagauacgugguggccgacugcggcggcggcaccguggaccugaccgugcaccagcuggagcagccccacggcacccugaaggagcuguacaaggccagcggcggccccuacggcgccgugggcguggaccuggccuucgagcagcugcugugcagaaucuucggcgaggacuucaucgccaccuucaagagacagagacccgccgccuggguggaccugaccaucgccuucgaggccagaaagagaaccgccggcccccacagagccggcgcccugaacaucagccugcccuucagcuucaucgacuucuacagaaagcagagaggccacaacguggagaccgcccugagaagaagcagcgugaacuucgugaaguggagcagccagggcaugcugagaaugagcugcgaggccaugaacgagcuguuccagcccaccgugagcggcaucauccagcacaucgaggcccugcuggccagacccgaggugcagggcgugaagcugcuguuccuggugggcggcuucgccgagagcgccgugcugcagcacgccgugcaggccgcccugggcgccagaggccugagagugguggugccccacgacgugggccugaccauccugaagggcgccgugcuguucggccaggcccccggcguggugagagugagaagaagcccccugaccuacggcgugggcgugcugaacagauucgugcccggcagacacccccccgagaagcugcuggugagagacggcagaagauggugcaccgacguguucgagagauucguggccgccgagcagagcguggcccugggcgaggaggugagaagaagcuacugccccgccagacccggccagagaagagugcugaucaaccuguacugcugcgccgccgaggacgccagauucaucaccgaccccggcgugagaaagugcggcgcccugagccuggagcuggagcccgccgacugcggccaggacaccgccggcgccccccccggcagaagagagaucagagccgccaugcaguucggcgacaccgagaucaaggugaccgccguggacgugagcaccaacagaagcgugagagccagcaucgacuuccugagcaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4237 - RNA, 1763 nt, Artificial Sequence
  mRNA product Design3 comprising derived and/or modified sequence from Homo sapiens__NP_008879.3__HsHSPA13 (opt4)
gggagagucccgcagucggcguccagcggcucugcuuguucgugugugugucguugcaggccuuauucaagcuuaccauggccagagagaugaccauccugggcagcgccgugcugacccugcugcuggccggcuaccuggcccagcaguaccugccccugcccacccccaaggugaucggcaucgaccugggcaccaccuacugcagcgugggcguguucuuccccggcaccggcaaggugaaggugauccccgacgagaacggccacaucagcauccccagcauggugagcuucaccgacaacgacguguacgugggcuacgagagcguggagcuggccgacagcaacccccagaacaccaucuacgacgccaagagauucaucggcaagaucuucaccgccgaggagcuggaggccgagaucggcagauaccccuucaaggugcugaacaagaacggcaugguggaguucagcgugaccagcaacgagaccaucaccgugagccccgaguacgugggcagcagacugcugcugaagcugaaggagauggccgaggccuaccugggcaugcccguggccaacgccgugaucagcgugcccgccgaguucgaccugaagcagagaaacagcaccaucgaggccgccaaccuggccggccugaagauccugagagugaucaacgagcccaccgccgccgccauggccuacggccugcacaaggccgacguguuccacgugcuggugaucgaccugggcggcggcacccuggacgugagccugcugaacaagcagggcggcauguuccugaccagagccaugagcggcaacaacaagcugggcggccaggacuucaaccagagacugcugcaguaccuguacaagcagaucuaccagaccuacggcuucgugcccagcagaaaggaggagauccacagacugagacaggccguggagauggugaagcugaaccugacccugcaccagagcgcccagcugagcgugcugcugaccguggaggagcaggacagaaaggagccccacagcagcgacaccgagcugcccaaggacaagcugagcagcgccgacgaccacagagugaacagcggcuucggcagaggccugagcgacaagaagagcggcgagagccaggugcuguucgagaccgagaucagcagaaagcuguucgacacccugaacgaggaccuguuccagaagauccuggugcccauccagcaggugcugaaggagggccaccuggagaagaccgagaucgacgagguggugcuggugggcggcagcaccagaauccccagaaucagacaggugauccaggaguucuucggcaaggaccccaacaccagcguggaccccgaccuggccguggugaccggcguggccauccaggccggcaucgacggcggcagcuggccccugcaggugagcgcccuggagauccccaacaagcaccugcagaagaccaacuucaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4238 - RNA, 1877 nt, Artificial Sequence
  mRNA product Design3 comprising derived and/or modified sequence from Homo sapiens__NP_057383.2__HsHSPA14 (opt4)
gggagagucccgcagucggcguccagcggcucugcuuguucgugugugugucguugcaggccuuauucaagcuuaccauggccgccaucggcgugcaccugggcugcaccagcgccugcguggccguguacaaggacggcagagccggcgugguggccaacgacgccggcgacagagugacccccgccgugguggccuacagcgagaacgaggagaucgugggccuggccgccaagcagagcagaaucagaaacaucagcaacaccgugaugaaggugaagcagauccugggcagaagcagcagcgacccccaggcccagaaguacaucgccgagagcaagugccuggugaucgagaagaacggcaagcugagauacgagaucgacaccggcgaggagaccaaguucgugaaccccgaggacguggccagacugaucuucagcaagaugaaggagaccgcccacagcgugcugggcagcgacgccaacgacguggugaucaccgugcccuucgacuucggcgagaagcagaagaacgcccugggcgaggccgccagagccgccggcuucaacgugcugagacugauccacgagcccagcgccgcccugcuggccuacggcaucggccaggacagccccaccggcaagagcaacauccugguguucaagcugggcggcaccagccugagccugagcgugauggaggugaacagcggcaucuacagagugcugagcaccaacaccgacgacaacaucggcggcgcccacuucaccgagacccuggcccaguaccuggccagcgaguuccagagaagcuucaagcacgacgugagaggcaacgccagagccaugaugaagcugaccaacagcgccgagguggccaagcacagccugagcacccugggcagcgccaacugcuuccuggacagccuguacgagggccaggacuucgacugcaacgugagcagagccagauucgagcugcugugcagcccccuguucaacaagugcaucgaggccaucagaggccugcuggaccagaacggcuucaccgccgacgacaucaacaagguggugcugugcggcggcagcagcagaauccccaagcugcagcagcugaucaaggaccuguuccccgccguggagcugcugaacagcaucccccccgacgaggugauccccaucggcgccgccaucgaggccggcauccugaucggcaaggagaaccugcugguggaggacagccugaugaucgagugcagcgccagagacauccuggugaagggcguggacgagagcggcgccagcagauucaccgugcuguuccccagcggcaccccccugcccgccagaagacagcacacccugcaggcccccggcagcaucagcagcgugugccuggagcuguacgagagcgacggcaagaacagcgccaaggaggagaccaaguucgcccagguggugcugcaggaccuggacaagaaggagaacggccugagagacauccuggccgugcugaccaugaagagagacggcagccugcacgugaccugcaccgaccaggagaccggcaagugcgaggccaucagcaucgagaucgccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4239 - RNA, 2924 nt, Artificial Sequence
  mRNA product Design3 comprising derived and/or modified sequence from Homo sapiens__NP_006635.2 __HsHSPH1 (opt4)
gggagagucccgcagucggcguccagcggcucugcuuguucgugugugugucguugcaggccuuauucaagcuuaccaugagcguggugggccuggacgugggcagccagagcugcuacaucgccguggccagagccggcggcaucgagaccaucgccaacgaguucagcgacagaugcacccccagcgugaucagcuucggcagcaagaacagaaccaucggcguggccgccaagaaccagcagaucacccacgccaacaacaccgugagcaacuucaagagauuccacggcagagccuucaacgaccccuucauccagaaggagaaggagaaccugagcuacgaccuggugccccugaagaacggcggcgugggcaucaaggugauguacaugggcgaggagcaccuguucagcguggagcagaucaccgccaugcugcugaccaagcugaaggagaccgccgagaacagccugaagaagcccgugaccgacugcgugaucagcgugcccagcuucuucaccgacgccgagagaagaagcgugcuggacgccgcccagaucgugggccugaacugccugagacugaugaacgacaugaccgccguggcccugaacuacggcaucuacaagcaggaccugcccagccuggacgagaagcccagaaucgugguguucguggacaugggccacagcgccuuccaggugagcgccugcgccuucaacaagggcaagcugaaggugcugggcaccgccuucgaccccuuccugggcggcaagaacuucgacgagaagcugguggagcacuucugcgccgaguucaagaccaaguacaagcuggacgccaagagcaagaucagagcccugcugagacuguaccaggagugcgagaagcugaagaagcugaugagcagcaacagcaccgaccugccccugaacaucgagugcuucaugaacgacaaggacgugagcggcaagaugaacagaagccaguucgaggagcugugcgccgagcugcugcagaagaucgaggugccccuguacagccugcuggagcagacccaccugaagguggaggacgugagcgccguggagaucgugggcggcgccaccagaauccccgccgugaaggagagaaucgccaaguucuucggcaaggacaucagcaccacccugaacgccgacgaggccguggccagaggcugcgcccugcagugcgccauccugagccccgccuucaaggugagagaguucagcgugaccgacgccgugcccuuccccaucagccugaucuggaaccacgacagcgaggacaccgagggcgugcacgagguguucagcagaaaccacgccgcccccuucagcaaggugcugaccuuccugagaagaggccccuucgagcuggaggccuucuacagcgacccccagggcgugcccuaccccgaggccaagaucggcagauucguggugcagaacgugagcgcccagaaggacggcgagaagagcagagugaaggugaaggugagagugaacacccacggcaucuucaccaucagcaccgccagcaugguggagaaggugcccaccgaggagaacgagaugagcagcgaggccgacauggagugccugaaccagagaccccccgagaaccccgacaccgacaagaacgugcagcaggacaacagcgaggccggcacccagccccaggugcagaccgacgcccagcagaccagccagagcccccccagccccgagcugaccagcgaggagaacaagauccccgacgccgacaaggccaacgagaagaagguggaccagccccccgaggccaagaagcccaagaucaagguggugaacguggagcugcccaucgaggccaaccugguguggcagcugggcaaggaccugcugaacauguacaucgagaccgagggcaagaugaucaugcaggacaagcuggagaaggagagaaacgacgccaagaacgccguggaggaguacguguacgaguucagagacaagcugugcggccccuacgagaaguucaucugcgagcaggaccaccagaacuuccugagacugcugaccgagaccgaggacuggcuguacgaggagggcgaggaccaggccaagcaggccuacguggacaagcuggaggagcugaugaagaucggcacccccgugaaggugagauuccaggaggccgaggagagacccaagauguucgaggagcugggccagagacugcagcacuacgccaagaucgccgccgacuucagaaacaaggacgagaaguacaaccacaucgacgagagcgagaugaagaagguggagaagagcgugaacgaggugauggaguggaugaacaacgugaugaacgcccaggccaagaagagccuggaccaggaccccguggugagagcccaggagaucaagaccaagaucaaggagcugaacaacaccugcgagcccguggugacccagcccaagcccaagaucgagagccccaagcuggagagaacccccaacggccccaacaucgacaagaaggaggaggaccuggaggacaagaacaacuucggcgccgagcccccccaccagaacggcgagugcuaccccaacgagaagaacagcgugaacauggaccuggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4240 - RNA, 3347 nt, Artificial Sequence
  mRNA product Design3 comprising derived and/or modified sequence from Homo sapiens__NP_006380.1 __HsHYOU1 (opt4)
gggagagucccgcagucggcguccagcggcucugcuuguucgugugugugucguugcaggccuuauucaagcuuaccauggccgacaaggugagaagacagagacccagaagaagagugugcugggcccugguggccgugcugcuggccgaccugcuggcccugagcgacacccuggccgugaugagcguggaccugggcagcgagagcaugaagguggccaucgugaagcccggcgugcccauggagaucgugcugaacaaggagagcagaagaaagacccccgugaucgugacccugaaggagaacgagagauucuucggcgacagcgccgccagcauggccaucaagaaccccaaggccacccugagauacuuccagcaccugcugggcaagcaggccgacaacccccacguggcccuguaccaggccagauuccccgagcacgagcugaccuucgacccccagagacagaccgugcacuuccagaucagcagccagcugcaguucagccccgaggaggugcugggcauggugcugaacuacagcagaagccuggccgaggacuucgccgagcagcccaucaaggacgccgugaucaccgugcccguguucuucaaccaggccgagagaagagccgugcugcaggccgccagaauggccggccugaaggugcugcagcugaucaacgacaacaccgccaccgcccugagcuacggcguguucagaagaaaggacaucaacaccaccgcccagaacaucauguucuacgacaugggcagcggcagcaccgugugcaccaucgugaccuaccagauggugaagaccaaggaggccggcaugcagccccagcugcagaucagaggcgugggcuucgacagaacccugggcggccuggagauggagcugagacugagagagagacuggccggccuguucaacgagcagagaaagggccagagagccaaggacgugagagagaaccccagagccauggccaagcugcugagagaggccaacagacugaagaccgugcugagcgccaacgccgaccacauggcccagaucgagggccugauggacgacguggacuucaaggccaaggugaccagaguggaguucgaggagcugugcgccgaccuguucgagagagugcccggccccgugcagcaggcccugcagagcgccgagaugagccuggacgagaucgagcaggugauccuggugggcggcgccaccagagugcccagagugcaggaggugcugcugaaggccgugggcaaggaggagcugggcaagaacaucaacgccgacgaggccgccgccaugggcgccguguaccaggccgccgcccugagcaaggccuucaaggugaagcccuucguggugagagacgccgugguguaccccauccugguggaguucaccagagagguggaggaggagcccggcauccacagccugaagcacaacaagagagugcuguucagcagaaugggccccuacccccagagaaaggugaucaccuucaacagauacagccacgacuucaacuuccacaucaacuacggcgaccugggcuuccugggccccgaggaccugagaguguucggcagccagaaccugaccaccgugaagcugaagggcgugggcgacagcuucaagaaguaccccgacuacgagagcaagggcaucaaggcccacuucaaccuggacgagagcggcgugcugagccuggacagaguggagagcguguucgagacccugguggaggacagcgccgaggaggagagcacccugaccaagcugggcaacaccaucagcagccuguucggcggcggcaccacccccgacgccaaggagaacggcaccgacaccgugcaggaggaggaggagagccccgccgagggcagcaaggacgagcccggcgagcagguggagcugaaggaggaggccgaggcccccguggaggacggcagccagccccccccccccgagcccaagggcgacgccacccccgagggcgagaaggccaccgagaaggagaacggcgacaagagcgaggcccagaagcccagcgagaaggccgaggccggccccgagggcguggcccccgcccccgagggcgagaagaagcagaagcccgccagaaagagaagaaugguggaggagaucggcguggagcugguggugcuggaccugcccgaccugcccgaggacaagcuggcccagagcgugcagaagcugcaggaccugacccugagagaccuggagaagcaggagagagagaaggccgccaacagccuggaggccuucaucuucgagacccaggacaagcuguaccagcccgaguaccaggaggugagcaccgaggagcagagagaggagaucagcggcaagcugagcgccgccagcaccuggcuggaggacgagggcgugggcgccaccaccgugaugcugaaggagaagcuggccgagcugagaaagcugugccagggccuguucuucagaguggaggagagaaagaaguggcccgagagacugagcgcccuggacaaccugcugaaccacagcagcauguuccugaagggcgccagacugauccccgagauggaccagaucuucaccgagguggagaugaccacccuggagaaggugaucaacgagaccugggccuggaagaacgccacccuggccgagcaggccaagcugcccgccaccgagaagcccgugcugcugagcaaggacaucgaggccaagaugauggcccuggacagagaggugcaguaccugcugaacaaggccaaguucaccaagcccagacccagacccaaggacaagaacggcaccagagccgagcccccccugaacgccagcgccagcgaccagggcgagaaggugaucccccccgccggccagaccgaggacgccgagcccaucagcgagcccgagaagguggagaccggcagcgagcccggcgacaccgagccccuggagcugggcggccccggcgccgagcccgagcagaaggagcagagcaccggccagaagagaccccugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4241 - RNA, 2546 nt, Artificial Sequence
  mRNA product Design3 comprising derived and/or modified sequence from Homo sapiens__NP_005339.3 __HsHSP90AA1 (opt4)
gggagagucccgcagucggcguccagcggcucugcuuguucgugugugugucguugcaggccuuauucaagcuuaccaugcccgaggagacccagacccaggaccagcccauggaggaggaggagguggagaccuucgccuuccaggccgagaucgcccagcugaugagccugaucaucaacaccuucuacagcaacaaggagaucuuccugagagagcugaucagcaacagcagcgacgcccuggacaagaucagauacgagagccugaccgaccccagcaagcuggacagcggcaaggagcugcacaucaaccugauccccaacaagcaggacagaacccugaccaucguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugaccgugaucaccaagcacaacgacgacgagcaguacgccugggagagcagcgccggcggcagcuucaccgugagaaccgacaccggcgagcccaugggcagaggcaccaaggugauccugcaccugaaggaggaccagaccgaguaccuggaggagagaagaaucaaggagaucgugaagaagcacagccaguucaucggcuaccccaucacccuguucguggagaaggagagagacaaggaggugagcgacgacgaggccgaggagaaggaggacaaggaggaggagaaggagaaggaggagaaggagagcgaggacaagcccgagaucgaggacgugggcagcgacgaggaggaggagaagaaggacggcgacaagaagaagaagaagaagaucaaggagaaguacaucgaccaggaggagcugaacaagaccaagcccaucuggaccagaaaccccgacgacaucaccaacgaggaguacggcgaguucuacaagagccugaccaacgacugggaggaccaccuggccgugaagcacuucagcguggagggccagcuggaguucagagcccugcuguucgugcccagaagagcccccuucgaccuguucgagaacagaaagaagaagaacaacaucaagcuguacgugagaagaguguucaucauggacaacugcgaggagcugauccccgaguaccugaacuucaucagaggcgugguggacagcgaggaccugccccugaacaucagcagagagaugcugcagcagagcaagauccugaaggugaucagaaagaaccuggugaagaagugccuggagcuguucaccgagcuggccgaggacaaggagaacuacaagaaguucuacgagcaguucagcaagaacaucaagcugggcauccacgaggacagccagaacagaaagaagcugagcgagcugcugagauacuacaccagcgccagcggcgacgagauggugagccugaaggacuacugcaccagaaugaaggagaaccagaagcacaucuacuacaucaccggcgagaccaaggaccagguggccaacagcgccuucguggagagacugagaaagcacggccuggaggugaucuacaugaucgagcccaucgacgaguacugcgugcagcagcugaaggaguucgagggcaagacccuggugagcgugaccaaggagggccuggagcugcccgaggacgaggaggagaagaagaagcaggaggagaagaagaccaaguucgagaaccugugcaagaucaugaaggacauccuggagaagaagguggagaaggugguggugagcaacagacuggugaccagccccugcugcaucgugaccagcaccuacggcuggaccgccaacauggagagaaucaugaaggcccaggcccugagagacaacagcaccaugggcuacauggccgccaagaagcaccuggagaucaaccccgaccacagcaucaucgagacccugagacagaaggccgaggccgacaagaacgacaagagcgugaaggaccuggugauccugcuguacgagaccgcccugcugagcagcggcuucagccuggaggacccccagacccacgccaacagaaucuacagaaugaucaagcugggccugggcaucgacgaggacgaccccaccgccgacgacaccagcgccgccgugaccgaggagaugcccccccuggagggcgacgacgacaccagcagaauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4242 - RNA, 686 nt, Artificial Sequence
  mRNA product Design3 comprising derived and/or modified sequence from Homo sapiens__NG_005218__HsHSP90AA3P (opt4)
gggagagucccgcagucggcguccagcggcucugcuuguucgugugugugucguugcaggccuuauucaagcuuaccauggacagcagcaagcuggacagcggcaagggccugcacaucaaccuggugcccaacaagcagaaccagacccugaccaucguggacaccagaaucggcaugaccaagaccgaccugaucaacaaccugggcaccgugaccaagagcggcaccaaggccuucauggaggcccugcaggccgacgccgacaucagcaugaucggccacuucggcgugggcuucuacagcgccuaccugguggccaagaaggugaccgugaucagcaagcacaacaacgacgagcaguacaccugggagagcagcgccggcggcagcuucaccgugagaaccgacgagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4243 - RNA, 2522 nt, Artificial Sequence
  mRNA product Design3 comprising derived and/or modified sequence from Homo sapiens__NP_031381.2__HsHSP90AB1 (opt4)
gggagagucccgcagucggcguccagcggcucugcuuguucgugugugugucguugcaggccuuauucaagcuuaccaugcccgaggaggugcaccacggcgaggaggagguggagaccuucgccuuccaggccgagaucgcccagcugaugagccugaucaucaacaccuucuacagcaacaaggagaucuuccugagagagcugaucagcaacgccagcgacgcccuggacaagaucagauacgagagccugaccgaccccagcaagcuggacagcggcaaggagcugaagaucgacaucauccccaacccccaggagagaacccugacccugguggacaccggcaucggcaugaccaaggccgaccugaucaacaaccugggcaccaucgccaagagcggcaccaaggccuucauggaggcccugcaggccggcgccgacaucagcaugaucggccaguucggcgugggcuucuacagcgccuaccugguggccgagaaggugguggugaucaccaagcacaacgacgacgagcaguacgccugggagagcagcgccggcggcagcuucaccgugagagccgaccacggcgagcccaucggcagaggcaccaaggugauccugcaccugaaggaggaccagaccgaguaccuggaggagagaagagugaaggagguggugaagaagcacagccaguucaucggcuaccccaucacccuguaccuggagaaggagagagagaaggagaucagcgacgacgaggccgaggaggagaagggcgagaaggaggaggaggacaaggacgacgaggagaagcccaagaucgaggacgugggcagcgacgaggaggacgacagcggcaaggacaagaagaagaagaccaagaagaucaaggagaaguacaucgaccaggaggagcugaacaagaccaagcccaucuggaccagaaaccccgacgacaucacccaggaggaguacggcgaguucuacaagagccugaccaacgacugggaggaccaccuggccgugaagcacuucagcguggagggccagcuggaguucagagcccugcuguucauccccagaagagcccccuucgaccuguucgagaacaagaagaagaagaacaacaucaagcuguacgugagaagaguguucaucauggacagcugcgacgagcugauccccgaguaccugaacuucaucagaggcgugguggacagcgaggaccugccccugaacaucagcagagagaugcugcagcagagcaagauccugaaggugaucagaaagaacaucgugaagaagugccuggagcuguucagcgagcuggccgaggacaaggagaacuacaagaaguucuacgaggccuucagcaagaaccugaagcugggcauccacgaggacagcaccaacagaagaagacugagcgagcugcugagauaccacaccagccagagcggcgacgagaugaccagccugagcgaguacgugagcagaaugaaggagacccagaagagcaucuacuacaucaccggcgagagcaaggagcagguggccaacagcgccuucguggagagagugagaaagagaggcuucgaggugguguacaugaccgagcccaucgacgaguacugcgugcagcagcugaaggaguucgacggcaagagccuggugagcgugaccaaggagggccuggagcugcccgaggacgaggaggagaagaagaagauggaggagagcaaggccaaguucgagaaccugugcaagcugaugaaggagauccuggacaagaagguggagaaggugaccaucagcaacagacuggugagcagccccugcugcaucgugaccagcaccuacggcuggaccgccaacauggagagaaucaugaaggcccaggcccugagagacaacagcaccaugggcuacaugauggccaagaagcaccuggagaucaaccccgaccaccccaucguggagacccugagacagaaggccgaggccgacaagaacgacaaggccgugaaggaccugguggugcugcuguucgagaccgcccugcugagcagcggcuucagccuggaggacccccagacccacagcaacagaaucuacagaaugaucaagcugggccugggcaucgacgaggacgagguggccgccgaggagcccaacgccgccgugcccgacgagauccccccccuggagggcgacgaggacgccagcagaauggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4244 - RNA, 2759 nt, Artificial Sequence
  mRNA product Design3 comprising derived and/or modified sequence from Homo sapiens__NP_003290.1__HsHSP90B1 (opt4)
gggagagucccgcagucggcguccagcggcucugcuuguucgugugugugucguugcaggccuuauucaagcuuaccaugagagcccugugggugcugggccugugcugcgugcugcugaccuucggcagcgugagagccgacgacgagguggacguggacggcaccguggaggaggaccugggcaagagcagagagggcagcagaaccgacgacgagguggugcagagagaggaggaggccauccagcuggacggccugaacgccagccagaucagagagcugagagagaagagcgagaaguucgccuuccaggccgaggugaacagaaugaugaagcugaucaucaacagccuguacaagaacaaggagaucuuccugagagagcugaucagcaacgccagcgacgcccuggacaagaucagacugaucagccugaccgacgagaacgcccugagcggcaacgaggagcugaccgugaagaucaagugcgacaaggagaagaaccugcugcacgugaccgacaccggcgugggcaugaccagagaggagcuggugaagaaccugggcaccaucgccaagagcggcaccagcgaguuccugaacaagaugaccgaggcccaggaggacggccagagcaccagcgagcugaucggccaguucggcgugggcuucuacagcgccuuccugguggccgacaaggugaucgugaccagcaagcacaacaacgacacccagcacaucugggagagcgacagcaacgaguucagcgugaucgccgaccccagaggcaacacccugggcagaggcaccaccaucacccuggugcugaaggaggaggccagcgacuaccuggagcuggacaccaucaagaaccuggugaagaaguacagccaguucaucaacuuccccaucuacguguggagcagcaagaccgagaccguggaggagcccauggaggaggaggaggccgccaaggaggagaaggaggagagcgacgacgaggccgccguggaggaggaggaggaggagaagaagcccaagaccaagaagguggagaagaccgugugggacugggagcugaugaacgacaucaagcccaucuggcagagacccagcaaggagguggaggaggacgaguacaaggccuucuacaagagcuucagcaaggagagcgacgaccccauggccuacauccacuucaccgccgagggcgaggugaccuucaagagcauccuguucgugcccaccagcgcccccagaggccuguucgacgaguacggcagcaagaagagcgacuacaucaagcuguacgugagaagaguguucaucaccgacgacuuccacgacaugaugcccaaguaccugaacuucgugaagggcgugguggacagcgacgaccugccccugaacgugagcagagagacccugcagcagcacaagcugcugaaggugaucagaaagaagcuggugagaaagacccuggacaugaucaagaagaucgccgacgacaaguacaacgacaccuucuggaaggaguucggcaccaacaucaagcugggcgugaucgaggaccacagcaacagaaccagacuggccaagcugcugagauuccagagcagccaccaccccaccgacaucaccagccuggaccaguacguggagagaaugaaggagaagcaggacaagaucuacuucauggccggcagcagcagaaaggaggccgagagcagccccuucguggagagacugcugaagaagggcuacgaggugaucuaccugaccgagcccguggacgaguacugcauccaggcccugcccgaguucgacggcaagagauuccagaacguggccaaggagggcgugaaguucgacgagagcgagaagaccaaggagagcagagaggccguggagaaggaguucgagccccugcugaacuggaugaaggacaaggcccugaaggacaagaucgagaaggccguggugagccagagacugaccgagagccccugcgcccugguggccagccaguacggcuggagcggcaacauggagagaaucaugaaggcccaggccuaccagaccggcaaggacaucagcaccaacuacuacgccagccagaagaagaccuucgagaucaaccccagacacccccugaucagagacaugcugagaagaaucaaggaggacgaggacgacaagaccgugcuggaccuggccguggugcuguucgagaccgccacccugagaagcggcuaccugcugcccgacaccaaggccuacggcgacagaaucgagagaaugcugagacugagccugaacaucgaccccgacgccaagguggaggaggagcccgaggaggagcccgaggagaccgccgaggacaccaccgaggacaccgagcaggacgaggacgaggagauggacgugggcaccgacgaggaggaggagaccgccaaggagagcaccgccgagaaggacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4245 - RNA, 2462 nt, Artificial Sequence
  mRNA product Design3 comprising derived and/or modified sequence from Homo sapiens__NP_057376.2__HsTRAP1 (opt4)
gggagagucccgcagucggcguccagcggcucugcuuguucgugugugugucguugcaggccuuauucaagcuuaccauggccagagagcugagagcccugcugcuguggggcagaagacugagaccccugcugagagcccccgcccuggccgccgugcccggcggcaagcccauccugugccccagaagaaccaccgcccagcugggccccagaagaaaccccgccuggagccugcaggccggcagacuguucagcacccagaccgccgaggacaaggaggagccccugcacagcaucaucagcagcaccgagagcgugcagggcagcaccagcaagcacgaguuccaggccgagaccaagaagcugcuggacaucguggccagaagccuguacagcgagaaggagguguucaucagagagcugaucagcaacgccagcgacgcccuggagaagcugagacacaagcuggugagcgacggccaggcccugcccgagauggagauccaccugcagaccaacgccgagaagggcaccaucaccauccaggacaccggcaucggcaugacccaggaggagcuggugagcaaccugggcaccaucgccagaagcggcagcaaggccuuccuggacgcccugcagaaccaggccgaggccagcagcaagaucaucggccaguucggcgugggcuucuacagcgccuucaugguggccgacagaguggagguguacagcagaagcgccgcccccggcagccugggcuaccaguggcugagcgacggcagcggcguguucgagaucgccgaggccagcggcgugagaaccggcaccaagaucaucauccaccugaagagcgacugcaaggaguucagcagcgaggccagagugagagacguggugaccaaguacagcaacuucgugagcuucccccuguaccugaacggcagaagaaugaacacccugcaggccaucuggaugauggaccccaaggacgugagagaguggcagcacgaggaguucuacagauacguggcccaggcccacgacaagcccagauacacccugcacuacaagaccgacgccccccugaacaucagaagcaucuucuacgugcccgacaugaagcccagcauguucgacgugagcagagagcugggcagcagcguggcccuguacagcagaaaggugcugauccagaccaaggccaccgacauccugcccaaguggcugagauucaucagaggcgugguggacagcgaggacaucccccugaaccugagcagagagcugcugcaggagagcgcccugaucagaaagcugagagacgugcugcagcagagacugaucaaguucuucaucgaccagagcaagaaggacgccgagaaguacgccaaguucuucgaggacuacggccuguucaugagagagggcaucgugaccgccaccgagcaggaggugaaggaggacaucgccaagcugcugagauacgagagcagcgcccugcccagcggccagcugaccagccugagcgaguacgccagcagaaugagagccggcaccagaaacaucuacuaccugugcgcccccaacagacaccuggccgagcacagccccuacuacgaggccaugaagaagaaggacaccgaggugcuguucugcuucgagcaguucgacgagcugacccugcugcaccugagagaguucgacaagaagaagcugaucagcguggagaccgacaucgugguggaccacuacaaggaggagaaguucgaggacagaagccccgccgccgagugccugagcgagaaggagaccgaggagcugauggccuggaugagaaacgugcugggcagcagagugaccaacgugaaggugacccugagacuggacacccaccccgccauggugaccgugcuggagaugggcgccgccagacacuuccugagaaugcagcagcuggccaagacccaggaggagagagcccagcugcugcagcccacccuggagaucaaccccagacacgcccugaucaagaagcugaaccagcugagagccagcgagcccggccuggcccagcugcugguggaccagaucuacgagaacgccaugaucgccgccggccugguggacgaccccagagccauggugggcagacugaacgagcugcuggugaaggcccuggagagacacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4246 - RNA, 809 nt, Artificial Sequence
  mRNA product Design3 comprising derived and/or modified sequence from Homo sapiens__NP_000609.1__HsIGF1 (opt4)
gggagagucccgcagucggcguccagcggcucugcuuguucgugugugugucguugcaggccuuauucaagcuuaccaugggcaagaucagcagccugcccacccagcuguucaagugcugcuucugcgacuuccugaaggugaagaugcacaccaugagcagcagccaccuguucuaccuggcccugugccugcugaccuucaccagcagcgccaccgccggccccgagacccugugcggcgccgagcugguggacgcccugcaguucgugugcggcgacagaggcuucuacuucaacaagcccaccggcuacggcagcagcagcagaagagccccccagaccggcaucguggacgagugcugcuucagaagcugcgaccugagaagacuggagauguacugcgccccccugaagcccgccaagagcgccagaagcgugagagcccagagacacaccgacaugcccaagacccagaaggaggugcaccugaagaacgccagcagaggcagcgccggcaacaagaacuacagaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4247 - RNA, 890 nt, Artificial Sequence
  mRNA product Design3 comprising derived and/or modified sequence from Homo sapiens__NP_000603.1__HsIGF2 (opt4)
gggagagucccgcagucggcguccagcggcucugcuuguucgugugugugucguugcaggccuuauucaagcuuaccaugggcauccccaugggcaagagcaugcuggugcugcugaccuuccuggccuucgccagcugcugcaucgccgccuacagacccagcgagacccugugcggcggcgagcugguggacacccugcaguucgugugcggcgacagaggcuucuacuucagcagacccgccagcagagugagcagaagaagcagaggcaucguggaggagugcugcuucagaagcugcgaccuggcccugcuggagaccuacugcgccacccccgccaagagcgagagagacgugagcaccccccccaccgugcugcccgacaacuuccccagauaccccgugggcaaguucuuccaguacgacaccuggaagcagagcacccagagacugagaagaggccugcccgcccugcugagagccagaagaggccacgugcuggccaaggagcuggaggccuucagagaggccaagagacacagaccccugaucgcccugcccacccaggaccccgcccacggcggcgccccccccgagauggccagcaacagaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4248 - RNA, 986 nt, Artificial Sequence
  mRNA product Design3 comprising derived and/or modified sequence from Homo sapiens__NP_000591.1__HsIL6 (opt4)
gggagagucccgcagucggcguccagcggcucugcuuguucgugugugugucguugcaggccuuauucaagcuuaccaugaacagcuucagcaccagcgccuucggccccguggccuucagccugggccugcugcuggugcugcccgccgccuuccccgcccccgugccccccggcgaggacagcaaggacguggccgccccccacagacagccccugaccagcagcgagagaaucgacaagcagaucagauacauccuggacggcaucagcgcccugagaaaggagaccugcaacaagagcaacaugugcgagagcagcaaggaggcccuggccgagaacaaccugaaccugcccaagauggccgagaaggacggcugcuuccagagcggcuucaacgaggagaccugccuggugaagaucaucaccggccugcuggaguucgagguguaccuggaguaccugcagaacagauucgagagcagcgaggagcaggccagagccgugcagaugagcaccaaggugcugauccaguuccugcagaagaaggccaagaaccuggacgccaucaccacccccgaccccaccaccaacgccagccugcugaccaagcugcaggcccagaaccaguggcugcaggacaugaccacccaccugauccugagaagcuucaaggaguuccugcagagcagccugagagcccugagacagaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4249 - RNA, 1628 nt, Artificial Sequence
  mRNA product Design3 comprising derived and/or modified sequence from Homo sapiens__NP_002183.1__HsINHBA (opt4)
gggagagucccgcagucggcguccagcggcucugcuuguucgugugugugucguugcaggccuuauucaagcuuaccaugccccugcuguggcugagaggcuuccugcuggccagcugcuggaucaucgugagaagcagccccacccccggcagcgagggccacagcgccgcccccgacugccccagcugcgcccuggccgcccugcccaaggacgugcccaacagccagcccgagaugguggaggccgugaagaagcacauccugaacaugcugcaccugaagaagagacccgacgugacccagcccgugcccaaggccgcccugcugaacgccaucagaaagcugcacgugggcaaggugggcgagaacggcuacguggagaucgaggacgacaucggcagaagagccgagaugaacgagcugauggagcagaccagcgagaucaucaccuucgccgagagcggcaccgccagaaagacccugcacuucgagaucagcaaggagggcagcgaccugagcgugguggagagagccgagguguggcuguuccugaaggugcccaaggccaacagaaccagaaccaaggugaccaucagacuguuccagcagcagaagcacccccagggcagccuggacaccggcgaggaggccgaggaggugggccugaagggcgagagaagcgagcugcugcugagcgagaaggugguggacgccagaaagagcaccuggcacguguuccccgugagcagcagcauccagagacugcuggaccagggcaagagcagccuggacgugagaaucgccugcgagcagugccaggagagcggcgccagccuggugcugcugggcaagaagaagaagaaggaggaggagggcgagggcaagaagaagggcggcggcgagggcggcgccggcgccgacgaggagaaggagcagagccacagacccuuccugaugcugcaggccagacagagcgaggaccacccccacagaagaagaagaagaggccuggagugcgacggcaaggugaacaucugcugcaagaagcaguucuucgugagcuucaaggacaucggcuggaacgacuggaucaucgcccccagcggcuaccacgccaacuacugcgagggcgagugccccagccacaucgccggcaccagcggcagcagccugagcuuccacagcaccgugaucaaccacuacagaaugagaggccacagccccuucgccaaccugaagagcugcugcgugcccaccaagcugagacccaugagcaugcuguacuacgacgacggccagaacaucaucaagaaggacauccagaacaugaucguggaggagugcggcugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4250 - RNA, 1571 nt, Artificial Sequence
  mRNA product Design3 comprising derived and/or modified sequence from Homo sapiens__NP_002184.2__HsINHBB (opt4)
gggagagucccgcagucggcguccagcggcucugcuuguucgugugugugucguugcaggccuuauucaagcuuaccauggacggccugcccggcagagcccugggcgccgccugccugcugcugcuggccgccggcuggcugggccccgaggccuggggcagccccacccccccccccacccccgccgcccccccccccccccccccccccggcagccccggcggcagccaggacaccugcaccagcugcggcggcuucagaagacccgaggagcugggcagaguggacggcgacuuccuggaggccgugaagagacacauccugagcagacugcagaugagaggcagacccaacaucacccacgccgugcccaaggccgccauggugaccgcccugagaaagcugcacgccggcaaggugagagaggacggcagaguggagaucccccaccuggacggccacgccagccccggcgccgacggccaggagagagugagcgagaucaucagcuucgccgagaccgacggccuggccagcagcagagugagacuguacuucuucaucagcaacgagggcaaccagaaccuguucguggugcaggccagccuguggcuguaccugaagcugcugcccuacgugcuggagaagggcagcagaagaaaggugagagugaagguguacuuccaggagcagggccacggcgacagauggaacaugguggagaagagaguggaccugaagagaagcggcuggcacaccuucccccugaccgaggccauccaggcccuguucgagagaggcgagagaagacugaaccuggacgugcagugcgacagcugccaggagcuggccguggugcccguguucguggaccccggcgaggagagccacagacccuucgugguggugcaggccagacugggcgacagcagacacagaaucagaaagagaggccuggagugcgacggcagaaccaaccugugcugcagacagcaguucuucaucgacuucagacugaucggcuggaacgacuggaucaucgcccccaccggcuacuacggcaacuacugcgagggcagcugccccgccuaccuggccggcgugcccggcagcgccagcagcuuccacaccgccguggugaaccaguacagaaugagaggccugaaccccggcaccgugaacagcugcugcauccccaccaagcugagcaccaugagcaugcuguacuucgacgacgaguacaacaucgugaagagagacgugcccaacaugaucguggaggagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4251 - RNA, 3806 nt, Artificial Sequence
  mRNA product Design3 comprising derived and/or modified sequence from Homo sapiens__NP_000623.2__HsITGAM (opt4)
gggagagucccgcagucggcguccagcggcucugcuuguucgugugugugucguugcaggccuuauucaagcuuaccauggcccugagagugcugcugcugaccgcccugacccugugccacggcuucaaccuggacaccgagaacgccaugaccuuccaggagaacgccagaggcuucggccagagcguggugcagcugcagggcagcagagugguggugggcgccccccaggagaucguggccgccaaccagagaggcagccuguaccagugcgacuacagcaccggcagcugcgagcccaucagacugcaggugcccguggaggccgugaacaugagccugggccugagccuggccgccaccaccagccccccccagcugcuggccugcggccccaccgugcaccagaccugcagcgagaacaccuacgugaagggccugugcuuccuguucggcagcaaccugagacagcagccccagaaguuccccgaggcccugagaggcugcccccaggaggacagcgacaucgccuuccugaucgacggcagcggcagcaucaucccccacgacuucagaagaaugaaggaguucgugagcaccgugauggagcagcugaagaagagcaagacccuguucagccugaugcaguacagcgaggaguucagaauccacuucaccuucaaggaguuccagaacaaccccaaccccagaagccuggugaagcccaucacccagcugcugggcagaacccacaccgccaccggcaucagaaagguggugagagagcuguucaacaucaccaacggcgccagaaagaacgccuucaagauccugguggugaucaccgacggcgagaaguucggcgacccccugggcuacgaggacgugauccccgaggccgacagagagggcgugaucagauacgugaucggcgugggcgacgccuucagaagcgagaagagcagacaggagcugaacaccaucgccagcaagccccccagagaccacguguuccaggugaacaacuucgaggcccugaagaccauccagaaccagcugagagagaagaucuucgccaucgagggcacccagaccggcagcagcagcagcuucgagcacgagaugagccaggagggcuucagcgccgccaucaccagcaacggcccccugcugagcaccgugggcagcuacgacugggccggcggcguguuccuguacaccagcaaggagaagagcaccuucaucaacaugaccagaguggacagcgacaugaacgacgccuaccugggcuacgccgccgccaucauccugagaaacagagugcagagccuggugcugggcgcccccagauaccagcacaucggccugguggccauguucagacagaacaccggcaugugggagagcaacgccaacgugaagggcacccagaucggcgccuacuucggcgccagccugugcagcguggacguggacagcaacggcagcaccgaccuggugcugaucggcgccccccacuacuacgagcagaccagaggcggccaggugagcgugugcccccugcccagaggcagagccagauggcagugcgacgccgugcuguacggcgagcagggccagcccuggggcagauucggcgccgcccugaccgugcugggcgacgugaacggcgacaagcugaccgacguggccaucggcgcccccggcgaggaggacaacagaggcgccguguaccuguuccacggcaccagcggcagcggcaucagccccagccacagccagagaaucgccggcagcaagcugagccccagacugcaguacuucggccagagccugagcggcggccaggaccugaccauggacggccugguggaccugaccgugggcgcccagggccacgugcugcugcugagaagccagcccgugcugagagugaaggccaucauggaguucaaccccagagagguggccagaaacguguucgagugcaacgaccagguggugaagggcaaggaggccggcgaggugagagugugccugcacgugcagaagagcaccagagacagacugagagagggccagauccagagcguggugaccuacgaccuggcccuggacagcggcagaccccacagcagagccguguucaacgagaccaagaacagcaccagaagacagacccaggugcugggccugacccagaccugcgagacccugaagcugcagcugcccaacugcaucgaggaccccgugagccccaucgugcugagacugaacuucagccuggugggcaccccccugagcgccuucggcaaccugagacccgugcuggccgaggacgcccagagacuguucaccgcccuguuccccuucgagaagaacugcggcaacgacaacaucugccaggacgaccugagcaucaccuucagcuucaugagccuggacugccugguggugggcggccccagagaguucaacgugaccgugaccgugagaaacgacggcgaggacagcuacagaacccaggugaccuucuucuucccccuggaccugagcuacagaaaggugagcacccugcagaaccagagaagccagagaagcuggagacuggccugcgagagcgccagcagcaccgaggugagcggcgcccugaagagcaccagcugcagcaucaaccaccccaucuuccccgagaacagcgaggugaccuucaacaucaccuucgacguggacagcaaggccagccugggcaacaagcugcugcugaaggccaacgugaccagcgagaacaacaugcccagaaccaacaagaccgaguuccagcuggagcugcccgugaaguacgccguguacaugguggugaccagccacggcgugagcaccaaguaccugaacuucaccgccagcgagaacaccagcagagugaugcagcaccaguaccaggugagcaaccugggccagagaagccugcccaucagccugguguuccuggugcccgugagacugaaccagaccgugaucugggacagaccccaggugaccuucagcgagaaccugagcagcaccugccacaccaaggagagacugcccagccacagcgacuuccuggccgagcugagaaaggcccccguggugaacugcagcaucgccgugugccagagaauccagugcgacauccccuucuucggcauccaggaggaguucaacgccacccugaagggcaaccugagcuucgacugguacaucaagaccagccacaaccaccugcugaucgugagcaccgccgagauccuguucaacgacagcguguucacccugcugcccggccagggcgccuucgugagaagccagaccgagaccaagguggagcccuucgaggugcccaacccccugccccugaucgugggcagcagcgugggcggccugcugcugcuggcccugaucaccgccgcccuguacaagcugggcuucuucaagagacaguacaaggacaugaugagcgagggcggcccccccggcgccgagccccagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4252 - RNA, 1751 nt, Artificial Sequence
  mRNA product Design3 comprising derived and/or modified sequence from Homo sapiens__NP_002415.1__HsMMP8 (opt4)
gggagagucccgcagucggcguccagcggcucugcuuguucgugugugugucguugcaggccuuauucaagcuuaccauguucagccugaagacccugcccuuccugcugcugcugcacgugcagaucagcaaggccuuccccgugagcagcaaggagaagaacaccaagaccgugcaggacuaccuggagaaguucuaccagcugcccagcaaccaguaccagagcaccagaaagaacggcaccaacgugaucguggagaagcugaaggagaugcagagauucuucggccugaacgugaccggcaagcccaacgaggagacccuggacaugaugaagaagcccagaugcggcgugcccgacagcggcggcuucaugcugacccccggcaaccccaagugggagagaaccaaccugaccuacagaaucagaaacuacaccccccagcugagcgaggccgagguggagagagccaucaaggacgccuucgagcuguggagcguggccagcccccugaucuucaccagaaucagccagggcgaggccgacaucaacaucgccuucuaccagagagaccacggcgacaacagccccuucgacggccccaacggcauccuggcccacgccuuccagcccggccagggcaucggcggcgacgcccacuucgacgccgaggagaccuggaccaacaccagcgccaacuacaaccuguuccugguggccgcccacgaguucggccacagccugggccuggcccacagcagcgaccccggcgcccugauguaccccaacuacgccuucagagagaccagcaacuacagccugccccaggacgacaucgacggcauccaggccaucuacggccugagcagcaaccccauccagcccaccggccccagcacccccaagcccugcgaccccagccugaccuucgacgccaucaccacccugagaggcgagauccuguucuucaaggacagauacuucuggagaagacacccccagcugcagagaguggagaugaacuucaucagccuguucuggcccagccugcccaccggcauccaggccgccuacgaggacuucgacagagaccugaucuuccuguucaagggcaaccaguacugggcccugagcggcuacgacauccugcagggcuaccccaaggacaucagcaacuacggcuuccccagcagcgugcaggccaucgacgccgccguguucuacagaagcaagaccuacuucuucgugaacgaccaguucuggagauacgacaaccagagacaguucauggagcccggcuaccccaagagcaucagcggcgccuuccccggcaucgagagcaagguggacgccguguuccagcaggagcacuucuuccacguguucagcggccccagauacuacgccuucgaccugaucgcccagagagugaccagaguggccagaggcaacaaguggcugaacugcagauacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4253 - RNA, 2471 nt, Artificial Sequence
  mRNA product Design3 comprising derived and/or modified sequence from Homo sapiens__NP_004985.2__HsMMP9 (opt4)
gggagagucccgcagucggcguccagcggcucugcuuguucgugugugugucguugcaggccuuauucaagcuuaccaugagccuguggcagccccuggugcuggugcugcuggugcugggcugcugcuucgccgcccccagacagagacagagcacccuggugcuguuccccggcgaccugagaaccaaccugaccgacagacagcuggccgaggaguaccuguacagauacggcuacaccagaguggccgagaugagaggcgagagcaagagccugggccccgcccugcugcugcugcagaagcagcugagccugcccgagaccggcgagcuggacagcgccacccugaaggccaugagaacccccagaugcggcgugcccgaccugggcagauuccagaccuucgagggcgaccugaaguggcaccaccacaacaucaccuacuggauccagaacuacagcgaggaccugcccagagccgugaucgacgacgccuucgccagagccuucgcccuguggagcgccgugaccccccugaccuucaccagaguguacagcagagacgccgacaucgugauccaguucggcguggccgagcacggcgacggcuaccccuucgacggcaaggacggccugcuggcccacgccuucccccccggccccggcauccagggcgacgcccacuucgacgacgacgagcuguggagccugggcaagggcgugguggugcccaccagauucggcaacgccgacggcgccgccugccacuuccccuucaucuucgagggcagaagcuacagcgccugcaccaccgacggcagaagcgacggccugcccuggugcagcaccaccgccaacuacgacaccgacgacagauucggcuucugccccagcgagagacuguacacccaggacggcaacgccgacggcaagcccugccaguuccccuucaucuuccagggccagagcuacagcgccugcaccaccgacggcagaagcgacggcuacagauggugcgccaccaccgccaacuacgacagagacaagcuguucggcuucugccccaccagagccgacagcaccgugaugggcggcaacagcgccggcgagcugugcguguuccccuucaccuuccugggcaaggaguacagcaccugcaccagcgagggcagaggcgacggcagacuguggugcgccaccaccagcaacuucgacagcgacaagaaguggggcuucugccccgaccagggcuacagccuguuccugguggccgcccacgaguucggccacgcccugggccuggaccacagcagcgugcccgaggcccugauguaccccauguacagauucaccgagggccccccccugcacaaggacgacgugaacggcaucagacaccuguacggccccagacccgagcccgagcccagaccccccaccaccaccaccccccagcccaccgccccccccaccgugugccccaccggcccccccaccgugcaccccagcgagagacccaccgccggccccaccggcccccccagcgccggccccaccggcccccccaccgccggccccagcaccgccaccaccgugccccugagccccguggacgacgccugcaacgugaacaucuucgacgccaucgccgagaucggcaaccagcuguaccuguucaaggacggcaaguacuggagauucagcgagggcagaggcagcagaccccagggccccuuccugaucgccgacaaguggcccgcccugcccagaaagcuggacagcguguucgaggagagacugagcaagaagcuguucuucuucagcggcagacagguguggguguacaccggcgccagcgugcugggccccagaagacuggacaagcugggccugggcgccgacguggcccaggugaccggcgcccugagaagcggcagaggcaagaugcugcuguucagcggcagaagacuguggagauucgacgugaaggcccagaugguggaccccagaagcgccagcgagguggacagaauguuccccggcgugccccuggacacccacgacguguuccaguacagagagaaggccuacuucugccaggacagauucuacuggagagugagcagcagaagcgagcugaaccagguggaccaggugggcuacgugaccuacgacauccugcagugccccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4254 - RNA, 1763 nt, Artificial Sequence
  mRNA product Design3 comprising derived and/or modified sequence from Homo sapiens__NP_002418.1__HsMMP13 (opt4)
gggagagucccgcagucggcguccagcggcucugcuuguucgugugugugucguugcaggccuuauucaagcuuaccaugcaccccggcgugcuggccgccuuccuguuccugagcuggacccacugcagagcccugccccugcccagcggcggcgacgaggacgaccugagcgaggaggaccugcaguucgccgagagauaccugagaagcuacuaccaccccaccaaccuggccggcauccugaaggagaacgccgccagcagcaugaccgagagacugagagagaugcagagcuucuucggccuggaggugaccggcaagcuggacgacaacacccuggacgugaugaagaagcccagaugcggcgugcccgacgugggcgaguacaacguguuccccagaacccugaaguggagcaagaugaaccugaccuacagaaucgugaacuacacccccgacaugacccacagcgagguggagaaggccuucaagaaggccuucaagguguggagcgacgugaccccccugaacuucaccagacugcacgacggcaucgccgacaucaugaucagcuucggcaucaaggagcacggcgacuucuaccccuucgacggccccagcggccugcuggcccacgccuucccccccggccccaacuacggcggcgacgcccacuucgacgacgacgagaccuggaccagcagcagcaagggcuacaaccuguuccugguggccgcccacgaguucggccacagccugggccuggaccacagcaaggaccccggcgcccugauguuccccaucuacaccuacaccggcaagagccacuucaugcugcccgacgacgacgugcagggcauccagagccuguacggccccggcgacgaggaccccaaccccaagcaccccaagacccccgacaagugcgaccccagccugagccuggacgccaucaccagccugagaggcgagaccaugaucuucaaggacagauucuucuggagacugcacccccagcagguggacgccgagcuguuccugaccaagagcuucuggcccgagcugcccaacagaaucgacgccgccuacgagcaccccagccacgaccugaucuucaucuucagaggcagaaaguucugggcccugaacggcuacgacauccuggagggcuaccccaagaagaucagcgagcugggccugcccaaggaggugaagaagaucagcgccgccgugcacuucgaggacaccggcaagacccugcuguucagcggcaaccagguguggagauacgacgacaccaaccacaucauggacaaggacuaccccagacugaucgaggaggacuuccccggcaucggcgacaagguggacgccguguacgagaagaacggcuacaucuacuucuucaacggccccauccaguucgaguacagcaucuggagcaacagaaucgugagagugaugcccgccaacagcauccuguggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4255 - RNA, 1415 nt, Artificial Sequence
  mRNA product Design3 comprising derived and/or modified sequence from Homo sapiens__NP_001286.1__HsCCR1 (opt4)
gggagagucccgcagucggcguccagcggcucugcuuguucgugugugugucguugcaggccuuauucaagcuuaccauggagacccccaacaccaccgaggacuacgacaccaccaccgaguucgacuacggcgacgccacccccugccagaaggugaacgagagagccuucggcgcccagcugcugcccccccuguacagccugguguucgugaucggccuggugggcaacauccugguggugcuggugcuggugcaguacaagagacugaagaacaugaccagcaucuaccugcugaaccuggccaucagcgaccugcuguuccuguucacccugcccuucuggaucgacuacaagcugaaggacgacuggguguucggcgacgccaugugcaagauccugagcggcuucuacuacaccggccuguacagcgagaucuucuucaucauccugcugaccaucgacagauaccuggccaucgugcacgccguguucgcccugagagccagaaccgugaccuucggcgugaucaccagcaucaucaucugggcccuggccauccuggccagcaugcccggccuguacuucagcaagacccagugggaguucacccaccacaccugcagccugcacuucccccacgagagccugagagaguggaagcuguuccaggcccugaagcugaaccuguucggccuggugcugccccugcuggugaugaucaucugcuacaccggcaucaucaagauccugcugagaagacccaacgagaagaagagcaaggccgugagacugaucuucgugaucaugaucaucuucuuccuguucuggacccccuacaaccugaccauccugaucagcguguuccaggacuuccuguucacccacgagugcgagcagagcagacaccuggaccuggccgugcaggugaccgaggugaucgccuacacccacugcugcgugaaccccgugaucuacgccuucgugggcgagagauucagaaaguaccugagacagcuguuccacagaagaguggccgugcaccuggugaaguggcugcccuuccugagcguggacagacuggagagagugagcagcaccagccccagcaccggcgagcacgagcugagcgccggcuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4256 - RNA, 983 nt, Artificial Sequence
  mRNA product Design3 comprising derived and/or modified sequence from Homo sapiens__NP_002598.4__HsPDGFA (opt4)
gggagagucccgcagucggcguccagcggcucugcuuguucgugugugugucguugcaggccuuauucaagcuuaccaugagaacccuggccugccugcugcugcugggcugcggcuaccuggcccacgugcuggccgaggaggccgagauccccagagaggugaucgagagacuggccagaagccagauccacagcaucagagaccugcagagacugcuggagaucgacagcgugggcagcgaggacagccuggacaccagccugagagcccacggcgugcacgccaccaagcacgugcccgagaagagaccccugcccaucagaagaaagagaagcaucgaggaggccgugcccgccgugugcaagaccagaaccgugaucuacgagauccccagaagccagguggaccccaccagcgccaacuuccugaucuggccccccugcguggaggugaagagaugcaccggcugcugcaacaccagcagcgugaagugccagcccagcagagugcaccacagaagcgugaagguggccaagguggaguacgugagaaagaagcccaagcugaaggaggugcaggugagacuggaggagcaccuggagugcgccugcgccaccaccagccugaaccccgacuacagagaggaggacaccggcagacccagagagagcggcaagaagagaaagagaaagagacugaagcccaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4257 - RNA, 1073 nt, Artificial Sequence
  mRNA product Design3 comprising derived and/or modified sequence from Homo sapiens__NP_002599.1__HsPDGFB (opt4)
gggagagucccgcagucggcguccagcggcucugcuuguucgugugugugucguugcaggccuuauucaagcuuaccaugaacagaugcugggcccuguuccugagccugugcugcuaccugagacuggugagcgccgagggcgaccccauccccgaggagcuguacgagaugcugagcgaccacagcaucagaagcuucgacgaccugcagagacugcugcacggcgaccccggcgaggaggacggcgccgagcuggaccugaacaugaccagaagccacagcggcggcgagcuggagagccuggccagaggcagaagaagccugggcagccugaccaucgccgagcccgccaugaucgccgagugcaagaccagaaccgagguguucgagaucagcagaagacugaucgacagaaccaacgccaacuuccugguguggccccccugcguggaggugcagagaugcagcggcugcugcaacaacagaaacgugcagugcagacccacccaggugcagcugagacccgugcaggugagaaagaucgagaucgugagaaagaagcccaucuucaagaaggccaccgugacccuggaggaccaccuggccugcaagugcgagaccguggccgccgccagacccgugaccagaagccccggcggcagccaggagcagagagccaagaccccccagaccagagugaccaucagaaccgugagagugagaagaccccccaagggcaagcacagaaaguucaagcacacccacgacaagaccgcccugaaggagacccugggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4258 - RNA, 1385 nt, Artificial Sequence
  mRNA product Design3 comprising derived and/or modified sequence from Homo sapiens__NP_057289.1__HsPDGFC (opt4)
gggagagucccgcagucggcguccagcggcucugcuuguucgugugugugucguugcaggccuuauucaagcuuaccaugagccuguucggccugcugcugcugaccagcgcccuggccggccagagacagggcacccaggccgagagcaaccugagcagcaaguuccaguucagcagcaacaaggagcagaacggcgugcaggacccccagcacgagagaaucaucaccgugagcaccaacggcagcauccacagccccagauucccccacaccuaccccagaaacaccgugcugguguggagacugguggccguggaggagaacguguggauccagcugaccuucgacgagagauucggccuggaggaccccgaggacgacaucugcaaguacgacuucguggagguggaggagcccagcgacggcaccauccugggcagauggugcggcagcggcaccgugcccggcaagcagaucagcaagggcaaccagaucagaaucagauucgugagcgacgaguacuuccccagcgagcccggcuucugcauccacuacaacaucgugaugccccaguucaccgaggccgugagccccagcgugcugccccccagcgcccugccccuggaccugcugaacaacgccaucaccgccuucagcacccuggaggaccugaucagauaccuggagcccgagagauggcagcuggaccuggaggaccuguacagacccaccuggcagcugcugggcaaggccuucguguucggcagaaagagcagagugguggaccugaaccugcugaccgaggaggugagacuguacagcugcacccccagaaacuucagcgugagcaucagagaggagcugaagagaaccgacaccaucuucuggcccggcugccugcuggugaagagaugcggcggcaacugcgccugcugccugcacaacugcaacgagugccagugcgugcccagcaaggugaccaagaaguaccacgaggugcugcagcugagacccaagaccggcgugagaggccugcacaagagccugaccgacguggcccuggagcaccacgaggagugcgacugcgugugcagaggcagcaccggcggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4259 - RNA, 1442 nt, Artificial Sequence
  mRNA product Design3 comprising derived and/or modified sequence from Homo sapiens__NP_149126.1__HsPDGFD (opt4)
gggagagucccgcagucggcguccagcggcucugcuuguucgugugugugucguugcaggccuuauucaagcuuaccaugcacagacugaucuucguguacacccugaucugcgccaacuucugcagcugcagagacaccagcgccaccccccagagcgccagcaucaaggcccugagaaacgccaaccugagaagagacgaccuguacagaagagacgagaccauccaggugaagggcaacggcuacgugcagagccccagauuccccaacagcuaccccagaaaccugcugcugaccuggagacugcacagccaggagaacaccagaauccagcugguguucgacaaccaguucggccuggaggaggccgagaacgacaucugcagauacgacuucguggagguggaggacaucagcgagaccagcaccaucaucagaggcagauggugcggccacaaggaggugccccccagaaucaagagcagaaccaaccagaucaagaucaccuucaagagcgacgacuacuucguggccaagcccggcuucaagaucuacuacagccugcuggaggacuuccagcccgccgccgccagcgagaccaacugggagagcgugaccagcagcaucagcggcgugagcuacaacagccccagcgugaccgaccccacccugaucgccgacgcccuggacaagaagaucgccgaguucgacaccguggaggaccugcugaaguacuucaaccccgagagcuggcaggaggaccuggagaacauguaccuggacacccccagauacagaggcagaagcuaccacgacagaaagagcaagguggaccuggacagacugaacgacgacgccaagagauacagcugcacccccagaaacuacagcgugaacaucagagaggagcugaagcuggccaacgugguguucuuccccagaugccugcuggugcagagaugcggcggcaacugcggcugcggcaccgugaacuggagaagcugcaccugcaacagcggcaagaccgugaagaaguaccacgaggugcugcaguucgagcccggccacaucaagagaagaggcagagccaagaccauggcccugguggacauccagcuggaccaccacgagagaugcgacugcaucugcagcagcagaccccccagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4260 - RNA, 1025 nt, Artificial Sequence
  mRNA product Design3 comprising derived and/or modified sequence from Homo sapiens__NP_003946.3__HsSOCS3 (opt4)
gggagagucccgcagucggcguccagcggcucugcuuguucgugugugugucguugcaggccuuauucaagcuuaccauggugacccacagcaaguuccccgccgccggcaugagcagaccccuggacaccagccugagacugaagaccuucagcagcaagagcgaguaccagcugguggugaacgccgugagaaagcugcaggagagcggcuucuacuggagcgccgugaccggcggcgaggccaaccugcugcugagcgccgagcccgccggcaccuuccugaucagagacagcagcgaccagagacacuucuucacccugagcgugaagacccagagcggcaccaagaaccugagaauccagugcgagggcggcagcuucagccugcagagcgaccccagaagcacccagcccgugcccagauucgacugcgugcugaagcuggugcaccacuacaugcccccccccggcgcccccagcuuccccagcccccccaccgagcccagcagcgaggugcccgagcagcccagcgcccagccccugcccggcagcccccccagaagagccuacuacaucuacagcggcggcgagaagaucccccuggugcugagcagaccccugagcagcaacguggccacccugcagcaccugugcagaaagaccgugaacggccaccuggacagcuacgagaaggugacccagcugcccggccccaucagagaguuccuggaccaguacgacgccccccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4261 - RNA, 830 nt, Artificial Sequence
  mRNA product Design3 comprising derived and/or modified sequence from Homo sapiens__NP_003227.1__HsTGFA (opt4)
gggagagucccgcagucggcguccagcggcucugcuuguucgugugugugucguugcaggccuuauucaagcuuaccauggugcccagcgccggccagcuggcccuguucgcccugggcaucgugcuggccgccugccaggcccuggagaacagcaccagcccccugagcgccgacccccccguggccgccgccguggugagccacuucaacgacugccccgacagccacacccaguucugcuuccacggcaccugcagauuccuggugcaggaggacaagcccgccugcgugugccacagcggcuacgugggcgccagaugcgagcacgccgaccugcuggccgugguggccgccagccagaagaagcaggccaucaccgcccuggugguggugagcaucguggcccuggccgugcugaucaucaccugcgugcugauccacugcugccaggugagaaagcacugcgaguggugcagagcccugaucugcagacacgagaagcccagcgcccugcugaagggcagaaccgccugcugccacagcgagaccguggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4262 - RNA, 1520 nt, Artificial Sequence
  mRNA product Design3 comprising derived and/or modified sequence from Homo sapiens__NP_000651.3__HsTGFB1 (opt4)
gggagagucccgcagucggcguccagcggcucugcuuguucgugugugugucguugcaggccuuauucaagcuuaccaugccccccagcggccugagacugcugccccugcugcugccccugcuguggcugcuggugcugacccccggcagacccgccgccggccugagcaccugcaagaccaucgacauggagcuggugaagagaaagagaaucgaggccaucagaggccagauccugagcaagcugagacuggccagcccccccagccagggcgaggugccccccggcccccugcccgaggccgugcuggcccuguacaacagcaccagagacagaguggccggcgagagcgccgagcccgagcccgagcccgaggccgacuacuacgccaaggaggugaccagagugcugaugguggagacccacaacgagaucuacgacaaguucaagcagagcacccacagcaucuacauguucuucaacaccagcgagcugagagaggccgugcccgagcccgugcugcugagcagagccgagcugagacugcugagacugaagcugaagguggagcagcacguggagcuguaccagaaguacagcaacaacagcuggagauaccugagcaacagacugcuggcccccagcgacagccccgaguggcugagcuucgacgugaccggcguggugagacaguggcugagcagaggcggcgagaucgagggcuucagacugagcgcccacugcagcugcgacagcagagacaacacccugcagguggacaucaacggcuucaccaccggcagaagaggcgaccuggccaccauccacggcaugaacagacccuuccugcugcugauggccaccccccuggagagagcccagcaccugcagagcagcagacacagaagagcccuggacaccaacuacugcuucagcagcaccgagaagaacugcugcgugagacagcuguacaucgacuucagaaaggaccugggcuggaaguggauccacgagcccaagggcuaccacgccaacuucugccugggccccugccccuacaucuggagccuggacacccaguacagcaaggugcuggcccuguacaaccagcacaaccccggcgccagcgccgcccccugcugcgugccccaggcccuggagccccugcccaucguguacuacgugggcagaaagcccaagguggagcagcugagcaacaugaucgugagaagcugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4263 - RNA, 1592 nt, Artificial Sequence
  mRNA product Design3 comprising derived and/or modified sequence from Homo sapiens__NP_003229.1__HsTGFB2 (opt4)
gggagagucccgcagucggcguccagcggcucugcuuguucgugugugugucguugcaggccuuauucaagcuuaccaugcacuacugcgugcugagcgccuuccugauccugcaccuggugaccguggcccugagccugagcaccugcagcacccuggacauggaccaguucaugagaaagagaaucgaggccaucagaggccagauccugagcaagcugaagcugaccagcccccccgaggacuaccccgagcccgaggaggugccccccgaggugaucagcaucuacaacagcaccagagaccugcugcaggagaaggccagcagaagagccgccgccugcgagagagagagaagcgacgaggaguacuacgccaaggagguguacaagaucgacaugccccccuucuuccccagcgagaacgccaucccccccaccuucuacagacccuacuucagaaucgugagauucgacgugagcgccauggagaagaacgccagcaaccuggugaaggccgaguucagaguguucagacugcagaaccccaaggccagagugcccgagcagagaaucgagcuguaccagauccugaagagcaaggaccugaccagccccacccagagauacaucgacagcaagguggugaagaccagagccgagggcgaguggcugagcuucgacgugaccgacgccgugcacgaguggcugcaccacaaggacagaaaccugggcuucaagaucagccugcacugccccugcugcaccuucgugcccagcaacaacuacaucauccccaacaagagcgaggagcuggaggccagauucgccggcaucgacggcaccagcaccuacaccagcggcgaccagaagaccaucaagagcaccagaaagaagaacagcggcaagaccccccaccugcugcugaugcugcugcccagcuacagacuggagagccagcagaccaacagaagaaagaagagagcccuggacgccgccuacugcuucagaaacgugcaggacaacugcugccugagaccccuguacaucgacuucaagagagaccugggcuggaaguggauccacgagcccaagggcuacaacgccaacuucugcgccggcgccugccccuaccuguggagcagcgacacccagcacagcagagugcugagccuguacaacaccaucaaccccgaggccagcgccagccccugcugcgugagccaggaccuggagccccugaccauccuguacuacaucggcaagacccccaagaucgagcagcugagcaacaugaucgugaagagcugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4264 - RNA, 1586 nt, Artificial Sequence
  mRNA product Design3 comprising derived and/or modified sequence from Homo sapiens__NP_003230.1__HsTGFB3 (opt4)
gggagagucccgcagucggcguccagcggcucugcuuguucgugugugugucguugcaggccuuauucaagcuuaccaugaagaugcaccugcagagagcccugguggugcuggcccugcugaacuucgccaccgugagccugagccugagcaccugcaccacccuggacuucggccacaucaagaagaagagaguggaggccaucagaggccagauccugagcaagcugagacugaccagcccccccgagcccaccgugaugacccacgugcccuaccaggugcuggcccuguacaacagcaccagagagcugcuggaggagaugcacggcgagagagaggagggcugcacccaggagaacaccgagagcgaguacuacgccaaggagauccacaaguucgacaugauccagggccuggccgagcacaacgagcuggccgugugccccaagggcaucaccagcaagguguucagauucaacgugagcagcguggagaagaacagaaccaaccuguucagagccgaguucagagugcugagagugcccaaccccagcagcaagagaaacgagcagagaaucgagcuguuccagauccugagacccgacgagcacaucgccaagcagagauacaucggcggcaagaaccugcccaccagaggcaccgccgaguggcugagcuucgacgugaccgacaccgugagagaguggcugcugagaagagagagcaaccugggccuggagaucagcauccacugccccugccacaccuuccagcccaacggcgacauccuggagaacauccacgaggugauggagaucaaguucaagggcguggacaacgaggacgaccacggcagaggcgaccugggcagacugaagaagcagaaggaccaccacaacccccaccugauccugaugaugauccccccccacagacuggacaaccccggccagggcggccagagaaagaagagagcccuggacaccaacuacugcuucagaaaccuggaggagaacugcugcgugagaccccuguacaucgacuucagacaggaccugggcuggaagugggugcacgagcccaagggcuacuacgccaacuucugcagcggccccugccccuaccugagaagcgccgacaccacccacagcaccgugcugggccuguacaacacccugaaccccgaggccagcgccagccccugcugcgugccccaggaccuggagccccugaccauccuguacuacgugggcagaacccccaagguggagcagcugagcaacaugguggugaagagcugcaagugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4265 - RNA, 1733 nt, Artificial Sequence
  mRNA product Design3 comprising derived and/or modified sequence from Homo sapiens__NP_001057.1__HsTNFRSF1B (opt4)
gggagagucccgcagucggcguccagcggcucugcuuguucgugugugugucguugcaggccuuauucaagcuuaccauggcccccguggccgugugggccgcccuggccgugggccuggagcugugggccgccgcccacgcccugcccgcccagguggccuucacccccuacgcccccgagcccggcagcaccugcagacugagagaguacuacgaccagaccgcccagaugugcugcagcaagugcagccccggccagcacgccaagguguucugcaccaagaccagcgacaccgugugcgacagcugcgaggacagcaccuacacccagcuguggaacugggugcccgagugccugagcugcggcagcagaugcagcagcgaccagguggagacccaggccugcaccagagagcagaacagaaucugcaccugcagacccggcugguacugcgcccugagcaagcaggagggcugcagacugugcgccccccugagaaagugcagacccggcuucggcguggccagacccggcaccgagaccagcgacguggugugcaagcccugcgcccccggcaccuucagcaacaccaccagcagcaccgacaucugcagaccccaccagaucugcaacgugguggccauccccggcaacgccagcauggacgccgugugcaccagcaccagccccaccagaagcauggcccccggcgccgugcaccugccccagcccgugagcaccagaagccagcacacccagcccacccccgagcccagcaccgcccccagcaccagcuuccugcugcccaugggccccagcccccccgccgagggcagcaccggcgacuucgcccugcccgugggccugaucgugggcgugaccgcccugggccugcugaucaucggcguggugaacugcgugaucaugacccaggugaagaagaagccccugugccugcagagagaggccaaggugccccaccugcccgccgacaaggccagaggcacccagggccccgagcagcagcaccugcugaucaccgcccccagcagcagcagcagcagccuggagagcagcgccagcgcccuggacagaagagcccccaccagaaaccagccccaggcccccggcguggaggccagcggcgccggcgaggccagagccagcaccggcagcagcgacagcagccccggcggccacggcacccaggugaacgugaccugcaucgugaacgugugcagcagcagcgaccacagcagccagugcagcagccaggccagcagcaccaugggcgacaccgacagcagccccagcgagagccccaaggacgagcaggugcccuucagcaaggaggagugcgccuucagaagccagcuggagacccccgagacccugcugggcagcaccgaggagaagccccugccccugggcgugcccgacgccggcaugaagcccagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4266 - RNA, 860 nt, Artificial Sequence
  mRNA product Design3 comprising derived and/or modified sequence from Homo sapiens__NP_002623.2__HsPGF (opt4)
gggagagucccgcagucggcguccagcggcucugcuuguucgugugugugucguugcaggccuuauucaagcuuaccaugcccgugaugagacuguuccccugcuuccugcagcugcuggccggccuggcccugcccgccgugcccccccagcagugggcccugagcgccggcaacggcagcagcgagguggagguggugcccuuccaggagguguggggcagaagcuacugcagagcccuggagagacugguggacguggugagcgaguaccccagcgagguggagcacauguucagccccagcugcgugagccugcugagaugcaccggcugcugcggcgacgagaaccugcacugcgugcccguggagaccgccaacgugaccaugcagcugcugaagaucagaagcggcgacagacccagcuacguggagcugaccuucagccagcacgugagaugcgagugcagaccccugagagagaagaugaagcccgagagaagaagacccaagggcagaggcaagagaagaagagagaagcagagacccaccgacugccaccugugcggcgacgccgugcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4267 - RNA, 1586 nt, Artificial Sequence
  mRNA product Design3 comprising derived and/or modified sequence from Homo sapiens__NP_001020537.2__HsVEGFA (opt4)
gggagagucccgcagucggcguccagcggcucugcuuguucgugugugugucguugcaggccuuauucaagcuuaccaugaccgacagacagaccgacaccgcccccagccccagcuaccaccugcugcccggcagaagaagaaccguggacgccgccgccagcagaggccagggccccgagcccgcccccggcggcggcguggagggcgugggcgccagaggcguggcccugaagcuguucgugcagcugcugggcugcagcagauucggcggcgccguggugagagccggcgaggccgagcccagcggcgccgccagaagcgccagcagcggcagagaggagccccagcccgaggagggcgaggaggaggaggagaaggaggaggagagaggcccccaguggagacugggcgccagaaagcccggcagcuggaccggcgaggccgccgugugcgccgacagcgcccccgccgccagagccccccaggcccuggccagagccagcggcagaggcggcagaguggccagaagaggcgccgaggagagcggccccccccacagccccagcagaagaggcagcgccagcagagccggccccggcagagccagcgagaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4268 - RNA, 1046 nt, Artificial Sequence
  mRNA product Design3 comprising derived and/or modified sequence from Homo sapiens__NP_001165094.1__HsVEGFA (opt4)
gggagagucccgcagucggcguccagcggcucugcuuguucgugugugugucguugcaggccuuauucaagcuuaccaugaacuuccugcugagcugggugcacuggagccuggcccugcugcuguaccugcaccacgccaaguggagccaggccgcccccauggccgagggcggcggccagaaccaccacgagguggugaaguucauggacguguaccagagaagcuacugccaccccaucgagacccugguggacaucuuccaggaguaccccgacgagaucgaguacaucuucaagcccagcugcgugccccugaugagaugcggcggcugcugcaacgacgagggccuggagugcgugcccaccgaggagagcaacaucaccaugcagaucaugagaaucaagccccaccagggccagcacaucggcgagaugagcuuccugcagcacaacaagugcgagugcagacccaagaaggacagagccagacaggagaagaagagcgugagaggcaagggcaagggccagaagagaaagagaaagaagagcagauacaagagcuggagcguguacgugggcgccagaugcugccugaugcccuggagccugcccggcccccaccccugcggccccugcagcgagagaagaaagcaccuguucgugcaggacccccagaccugcaagugcagcugcaagaacaccgacagcagaugcaaggccagacagcuggagcugaacgagagaaccugcagaugcgacaagcccagaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4269 - RNA, 971 nt, Artificial Sequence
  mRNA product Design3 comprising derived and/or modified sequence from Homo sapiens__NP_003368.1__HsVEGFB (opt4)
gggagagucccgcagucggcguccagcggcucugcuuguucgugugugugucguugcaggccuuauucaagcuuaccaugagcccccugcugagaagacugcugcuggccgcccugcugcagcuggcccccgcccaggcccccgugagccagcccgacgcccccggccaccagagaaagguggugagcuggaucgacguguacaccagagccaccugccagcccagagaggugguggugccccugaccguggagcugaugggcaccguggccaagcagcuggugcccagcugcgugaccgugcagagaugcggcggcugcugccccgacgacggccuggagugcgugcccaccggccagcaccaggugagaaugcagauccugaugaucagauaccccagcagccagcugggcgagaugagccuggaggagcacagccagugcgagugcagacccaagaagaaggacagcgccgugaagcccgacagagccgccaccccccaccacagaccccagcccagaagcgugcccggcugggacagcgcccccggcgcccccagccccgccgacaucacccaccccacccccgcccccggccccagcgcccacgccgcccccagcaccaccagcgcccugacccccggccccgccgccgccgccgccgacgccgccgccagcagcguggccaagggcggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4270 - RNA, 1607 nt, Artificial Sequence
  mRNA product Design3 comprising derived and/or modified sequence from Homo sapiens__NP_005420.1__HsVEGFC (opt4)
gggagagucccgcagucggcguccagcggcucugcuuguucgugugugugucguugcaggccuuauucaagcuuaccaugcaccugcugggcuucuucagcguggccugcagccugcuggccgccgcccugcugcccggccccagagaggcccccgccgccgccgccgccuucgagagcggccuggaccugagcgacgccgagcccgacgccggcgaggccaccgccuacgccagcaaggaccuggaggagcagcugagaagcgugagcagcguggacgagcugaugaccgugcuguaccccgaguacuggaagauguacaagugccagcugagaaagggcggcuggcagcacaacagagagcaggccaaccugaacagcagaaccgaggagaccaucaaguucgccgccgcccacuacaacaccgagauccugaagagcaucgacaacgaguggagaaagacccagugcaugcccagagaggugugcaucgacgugggcaaggaguucggcguggccaccaacaccuucuucaagccccccugcgugagcguguacagaugcggcggcugcugcaacagcgagggccugcagugcaugaacaccagcaccagcuaccugagcaagacccuguucgagaucaccgugccccugagccagggccccaagcccgugaccaucagcuucgccaaccacaccagcugcagaugcaugagcaagcuggacguguacagacaggugcacagcaucaucagaagaagccugcccgccacccugccccagugccaggccgccaacaagaccugccccaccaacuacauguggaacaaccacaucugcagaugccuggcccaggaggacuucauguucagcagcgacgccggcgacgacagcaccgacggcuuccacgacaucugcggccccaacaaggagcuggacgaggagaccugccagugcgugugcagagccggccugagacccgccagcugcggcccccacaaggagcuggacagaaacagcugccagugcgugugcaagaacaagcuguuccccagccagugcggcgccaacagagaguucgacgagaacaccugccagugcgugugcaagagaaccugccccagaaaccagccccugaaccccggcaagugcgccugcgagugcaccgagagcccccagaagugccugcugaagggcaagaaguuccaccaccagaccugcagcugcuacagaagacccugcaccaacagacagaaggccugcgagcccggcuucagcuacagcgaggaggugugcagaugcgugcccagcuacuggaagagaccccagaugagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4271 - RNA, 1412 nt, Artificial Sequence
  mRNA product Design3 comprising derived and/or modified sequence from Homo sapiens__NP_004460.1__HsVEGFD (opt4)
gggagagucccgcagucggcguccagcggcucugcuuguucgugugugugucguugcaggccuuauucaagcuuaccauguacagagagugggugguggugaacguguucaugaugcuguacgugcagcuggugcagggcagcagcaacgagcacggccccgugaagagaagcagccagagcacccuggagagaagcgagcagcagaucagagccgccagcagccuggaggagcugcugagaaucacccacagcgaggacuggaagcuguggagaugcagacugagacugaagagcuucaccagcauggacagcagaagcgccagccacagaagcaccagauucgccgccaccuucuacgacaucgagacccugaaggugaucgacgaggaguggcagagaacccagugcagccccagagagaccugcguggagguggccagcgagcugggcaagagcaccaacaccuucuucaagccccccugcgugaacguguucagaugcggcggcugcugcaacgaggagagccugaucugcaugaacaccagcaccagcuacaucagcaagcagcuguucgagaucagcgugccccugaccagcgugcccgagcuggugcccgugaagguggccaaccacaccggcugcaagugccugcccaccgcccccagacaccccuacagcaucaucagaagaagcauccagauccccgaggaggacagaugcagccacagcaagaagcugugccccaucgacaugcugugggacagcaacaagugcaagugcgugcugcaggaggagaacccccuggccggcaccgaggaccacagccaccugcaggagcccgcccugugcggcccccacaugauguucgacgaggacagaugcgagugcgugugcaagacccccugccccaaggaccugauccagcaccccaagaacugcagcugcuucgagugcaaggagagccuggagaccugcugccagaagcacaagcuguuccaccccgacaccugcagcugcgaggacagaugccccuuccacaccagacccugcgccagcggcaagaccgccugcgccaagcacugcagauuccccaaggagaagagagccgcccagggcccccacagcagaaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4272 - RNA, 977 nt, Artificial Sequence
  mRNA product Design3 comprising derived and/or modified sequence from Homo sapiens__NP_061986.1__HsFGF21 (opt5)
gggagagucccgcagucggcguccagcggcucugcuuguucgugugugugucguugcaggccuuauucaagcuuaccauggacagcgaugagaccggcuucgaacacuccgggcugugggugucuguccucgccggacugcuucugggcgcuugccaggcccaucccaucccugacagcuccccgcuccugcaauuugggggacagguuagacagcgguaccuuuauacagaugacgcgcagcaaacggaggcucaccuggaaauucgcgaggauggcaccgugggcggagccgccgaccagucucccgaaagccuccugcagcugaaggcucucaaaccuggcgugauccagauucugggcgucaagacauccagauuccuuugucaacggcccgauggggcccuguacggaucucuccauuuugacccugaggcuugcagcuuccgcgagcugcuucuggaagauggcuauaacguguaccaguccgaggcccacgggcucccccugcaucugccuggaaauaaaagcccgcacagagaccccgcgccucggggccccgcccgcuuucucccucugcccgggcuuccgccugcucugcccgaaccucccggaauccucgcuccccagccuccggauguugggucuuccgacccccugagcauggugggcccuucucaggggagaucccccagcuaugccucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4273 - RNA, 1757 nt, Artificial Sequence
  mRNA product Design3 comprising derived and/or modified sequence from Homo sapiens__NP_002412.1__HsMMP1 (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucccggccacccucgagacacaggaacaagacguugaucuggugcagaaguaccuugagaaauauuacaaccugaagaaugacgggagacagguggaaaaacggcgcaacagcggacccgucguggagaagcucaaacagaugcaagaauuuuucggccugaagguuacggggaagccugaugcugagacccugaaagugaugaagcagcccagaugcggagucccugacguggcccaguuuguucucacagagggcaauccccggugggaacagacccaccugacauaucgcaucgagaacuacaccccugaucuuccgagagcggacguggaucaugcuauugaaaaagccuuccaacugugguccaaugucacaccccucaccuuuacgaaggugucugaggggcaggccgacaucaugauuagcuucgugcggggagaucaccgcgacaacuccccuuuugauggccccggcgggaaucuggcucaugccuuccagccuggacccggcaucgggggagacgcucacuuugaugaggacgaaagauggaccaacaauuuccgggaguauaaccuucaccgcgucgccgcgcaugaacugggccacucucucgggcugagccauuccacagacauuggagcccugauguacccgagcuauaccuuuucuggcgauguucagcucgcucaagacgauaucgacggcauccaggccauuuacgggagaucccagaauccugugcaacccaucggaccucagacacccaaggcuugugauagcaaacugaccuucgacgccauuacgacaauccggggcgaggugauguucuuuaaggaucgcuucuacaugagaaccaaccccuuuuauccugaagucgagcuuaauuucauuucuguguuuuggccgcagcugcccaacgggcucgaggcggccuacgaguucgcugaccgggaugaaguucgcuuuuucaaaggaaauaaguauugggccgugcagggccaaaacguccugcacggguacccuaaagacaucuauuccagcuuuggauuccccagaacagugaagcacauugaugcugcccuuucugaagagaacaccggcaaaaccuacuuuuucguugccaauaaguauuggcgguacgacgaauacaaaagauccauggacccuggcuaucccaagaugaucgcucaugauuuuccggggaucggacacaagguggacgcggucuucaugaaagauggcuucuuuuacuucuuucaugggacacgccaguauaaguucgacccuaaaacgaagcggauucugacccuccagaaagccaacagcugguuuaauugcagaaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4274 - RNA, 1517 nt, Artificial Sequence
  mRNA product Design3 comprising derived and/or modified sequence from Homo sapiens__NP_002412.1__HsMMP1(1-19,100-469) (opt5)
gggagagucccgcagucggcguccagcggcucugcuuguucgugugugugucguugcaggccuuauucaagcuuaccaugcacagcuuucccccucugcuccugcuucuguucuggggcguggucucccauucuuucguucucaccgaggggaacccgagaugggaacagacacaccugacguaccggauugagaauuauacccccgaccuuccucgcgccgauguggaccaugcuauugaaaaggccuuucaacuguggagcaacgugacaccccucaccuucacaaaagucuccgagggacaggcggauaucaugauuucuuuugugagaggcgaccaccgggauaauagcccuuucgacgggcccggaggcaaccuggcucaugccuuucagccugggccgggaaucggcggcgaugcccacuucgacgaagaugagcgcuggaccaauaacuuuagagaguacaaucugcaccggguugcugcccaugaacucgggcacucccugggacuuucucauagcacagacauuggcgcucugauguaucccuccuacaccuucagcggggaugugcagcucgcccaagacgauaucgacggaauccaggcgauuuauggccgcucucagaacccuguccagcccaucgggccucaaacgcccaaggccugcgacuccaaacugaccuuugaugcuauuacaaccaucagaggagaggugauguucuuuaaggaccgguucuacaugcgcacaaauccguucuauccugaaguugagcuuaacuuuauuagcguguucuggccccagcugccuaauggccucgaggccgcuuacgaauuugccgauagagacgagguccgguucuuuaaaggcaacaaguacugggcggugcaggggcagaaugugcugcacggauaucccaaggauaucuacucuuccuucggcuuuccccgcaccgucaaacacauugacgccgcucugagcgaagagaacacggggaagacauauuucuuuguugccaauaaauacuggagauaugaugaauacaagcggucuauggacccuggauauccgaaaaugaucgcucaugauuuccccggcaucgggcacaagguggacgccguguuuaugaaggauggauucuuuuacuucuuccauggcacccgccaauacaaauuugacccuaagacaaaaagaauccucacccugcagaaggccaacuccugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4275 - RNA, 3704 nt, Artificial Sequence
  mRNA product Design3 comprising derived and/or modified sequence from Clostridium histolyticum__BAA77453.1__ColG (opt5)
gggagagucccgcagucggcguccagcggcucugcuuguucgugugugugucguugcaggccuuauucaagcuuaccaugaagaaaaacauccugaagauucucauggacagcuacuccaaagagucuaagauccagaccgugagacgggucacaagcguuucccugcuugccguguaucugacgaugaauaccucuagccucgugcuggcuaaacccauugaaaacacaaaugauaccuccaucaagaacgucgagaaacuucgcaaugccccuaacgaagaaaauucuaaaaagguggaagacagcaaaaacgauaagguugagcacgugaaaaauauugaggaagcgaaggucgagcaaguggcuccggaaguuaaguccaaaagcacacugagaucugccuccaucgccaacaccaauagcgagaaguacgacuucgaguaucucaacggccugucuuacacagaacugaccaaucucaucaaaaacauuaaguggaaucagaucaacgggcuguuuaacuauuccacgggaagccagaaauucuuuggcgauaagaaucgggugcaggcuauuaucaacgcccuucaagagucugggcgcaccuacacagcuaaugacaugaaaggaauugaaaccuucacagagguccugagagccggcuuuuaucucggguacuacaacgauggacuguccuaucuuaaugaccggaacuuccaggauaagugcauccccgcgaugauugccauccagaagaauccuaacuuuaaacugggcaccgcugugcaggacgaagugaucacgagccucggcaagcugauugggaaugccuccgcuaacgccgaggucguuaauaacugugugcccgugcugaaacaauuccgcgagaaucucaaccaguacgcgccugauuaugucaagggaacagccgugaaugaacugaucaaaggcauugaguuugacuucucuggggcugccuacgaaaaggauguuaagaccaugcccugguauggaaaaaucgacccuuuuauuaacgagcuuaaggcucugggccucuacgggaacaucacaagcgccaccgaaugggccuccgacgugggaaucuauuaccugagcaaauucggccuuuacucuaccaauagaaacgauauuguccagucccuggagaaggcuguggacauguauaaauacggcaagaucgcguuuguugccauggagcggauuacaugggauuaugacgggaucggaagcaauggcaagaaaguggaucaugacaaguuccucgaugacgcugaaaaacacuaccugccgaagacguauaccuucgauaacgggacauuuauuauccgcgccggagacaaagucucugaggaaaagaucaagagacuguacugggccagccgggaggugaaaucccaguuccaucgcgucgugggcaaugauaaggcucucgaaguugggaacgccgacgacgugcugaccaugaaaauuuuuaauucucccgaggaguauaaguucaacacaaauaucaacggagucagcaccgauaauggcggccuuuacauugaaccuagagggacguuuuacacauaugagcggacaccccaacaguccaucuucagccuggaggagcucuuucgccacgaguacacccauuaucugcaggcgagauaccuuguggacggacuguggggccaagggccuuucuaugagaaaaaccggcucaccugguuugaugaaggaaccgcugaguucuuugccggcucuacaagaacguccgggguucugccccgcaagagcauucugggcuaccucgccaaagacaagguggaucaccgguauucucugaagaaaacccuuaauuccggauacgacgauagcgacuggauguucuacaacuauggcuuugcugucgcccacuaccuguaugaaaaggauaugccgacauucaucaaaaugaauaaggcuauucucaacaccgacgugaaauccuacgaugaaaucaucaagaagcugucugacgaugccaacaaaaauacagaguaucagaaccauauucaggagcuggcggacaaguaccagggggccggaaucccucuugugagcgacgauuaucucaaagaccacggcuacaagaaggcuuccgaaguuuacucugagauuagcaaggccgcuucccugaccaauacgagcgucaccgccgaaaagucucaauauuucaacacauuuacccugagagggacauacaccggagagacguccaaaggcgaguucaaggauugggacgaaaugagcaaaaagcucgaugggacacuggagucucuugcgaaaaauuccuggagcggcuauaagacccugacagccuacuuuaccaacuaucgcgugaccucugacaauaaggugcaguacgaugucguguuccauggaguucucacagacaacgcugauaucagcaauaacaaagcccccauugcuaaggugacgggcccuuccaccggggccgucggacggaauaucgaauuuagcggcaaagacucuaaggaugaggacgggaaaaucguguccuaugauugggacuucggagacggcgccacaagcagagggaagaacuccguucacgcuuacaaaaaggcgggcaccuacaaugugacacugaaggucaccgaugacaaaggagccacggcuacagaaucuuuuaccauugagaucaagaacgaagauaccacaacccccauuacaaaagagauggagcccaaugacgauaucaaggaagccaacggcccuauuguggaggggguuacggugaaaggagaccugaacggcagcgaugacgccgauaccuucuauuuugacgucaaggaagauggggacgugacaaucgagcuuccguacuccggaucuagcaauuucaccuggcucguguauaaggagggcgacgaucagaaccacaucgcuuccgggauugacaaaaauaacucuaaggucggcacauuuaaaagcaccaagggacgccauuacguuuucaucuauaaacacgauuccgccagcaauauuucuuacucccugaacaucaagggccuggggaaugaaaagcucaaagagaaggaaaacaaugacagcucugauaaagcgacggugauucccaacuuuaauaccacaaugcagggaucccugcuuggcgacgauagccgggacuauuacucuuucgaggugaaggaagagggggaggucaacaucgaacuggauaaaaaggacgaguucggagugaccuggacacuccauccugaauccaauaucaacgauagaauuaccuacggccaaguugacggcaauaaggugagcaacaaagucaagcugcgccccgggaaauauuaccugcuuguguauaaguacuccggaagcggcaauuaugagcuccggguuaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4276 - RNA, 3428 nt, Artificial Sequence
  mRNA product Design3 comprising derived and/or modified sequence from Clostridium histolyticum__BAA77453.1__HsALB(1-18)_ColG(111-1118) (opt5)
gggagagucccgcagucggcguccagcggcucugcuuguucgugugugugucguugcaggccuuauucaagcuuaccaugaagugggugaccuucaucagccugcucuuucuguucuccucugccuacagcauugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4277 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4278 - RNA, 3452 nt, Artificial Sequence
  mRNA product Design3 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaacuuccugaagaucauucucaauagaggcaaaaccaugaagcggaaaugccugagcaagcgccuuaugcuggccaucacaauggcuacgauuuuuaccgugaacuccacacuccccaucuacgccgcggucgacaaaaauaacgcuaccgccgccguucagaaugagucuaagagauauacagugagcuaccugaagacccuuaacuauuacgaucugguggaccuccuggucaaaacagaaauugagaaucugccugaucucuuccaauauuccucugacgcuaaggaauuuuacgggaacaaaacccggaugagcuucaucauggaugagaucggacgcagagccccgcaguauacggaaauugaccacaagggcauccccacccugguggagguugugcgggcuggguuuuaccuuggauuccauaauaaagagcugaacgaaauuaauaagcgcuccuuuaaggagagagucaucccuucuauucucgccauccagaaaaaccccaauuucaagcugggcacagaagugcaggauaaaauuguuagcgcgaccgggcuucuggccggaaacgagacagcuccucccgagguggucaauaacuuuaccccuauccuccaagacuguaucaagaacauugaucgguacgcccuggacgaucugaaauccaaggcucucuucaaugugcuggccgcgccgacguaugacaucacagaauaccuucgcgccaccaaagagaagcccgaaaacacaccuugguauggcaagauugauggcuuuaucaaugagcugaaaaagcucgcucuguacgggaaaauuaacgacaauaacagcuggaucaucgacaauggaauuuaucacaucgcuccccuuggcaagcugcauucuaacaauaaaauugggaucgaaacccucaccgaggugaugaaggucuacccuuaucuguccaugcagcaccuucagagcgccgaucagauuaagagacauuacgacucuaaagaugccgagggaaacaagaucccccucgacaaauucaagaaagaaggcaaggagaaguacugcccgaaaacauauacguuugaugacgggaagguuaucauuaaagccggagcucggguggaagaggaaaaggugaaacgccuguacugggcguccaaggaggucaauagccaauucuucagaguguauggcaucgauaagccucuugaggaaggcaaccccgacgauauucugaccaugguuaucuacaauucuccugaggaauauaaacucaacuccgugcuguacggguaugacacaaauaacggaggcauguacauugagcccgaagggaccuuuuucacauacgagcgggaggcccaggaaagcaccuauacgcuugaggaacuguuucgccacgaguacacacacuaucuccagggaagauacgcuguccccggccagugggggcggaccaagcuguaugauaacgacagacugaccugguacgaggaaggaggcgccgaacucuucgccggcuccacacgcaccucugggauccugccucggaaaagcauuguguccaauauccauaacacaacgagaaauaaccgcuauaagcugagcgacaccguucacucuaaauacggagcuuccuuugaguucuacaauuaugccuguauguuuauggauuacauguauaacaaggacaugggcauccugaauaaacucaacgaucuggcgaagaauaacgacguggauggguacgacaauuauauucgggaucugagcucuaacuacgcucuuaaugacaaguaucaagaucauaugcaggagagaaucgacaacuacgaaaaucucacagucccguucguggccgaugacuaccugguccgccacgccuauaaaaaccccaacgagauuuacagcgagaucuccgaaguggcuaagcugaaagaugccaagucugagguuaaaaagagccaguauuuuuccaccuucacacuccggggaagcuacaccggcggggcuucuaagggcaaacuggaagaccaaaaggccaugaauaaauuuauugacgauucccuuaagaaacuggacacguauagcuggucuggauacaagacccucacagcguauuucaccaacuacaagguggauuccagcaauagagucacauacgacgugguuuuucacggcuaucugccuaacgagggggauuccaaaaauucucugcccuacggaaagaucaacggcaccuauaaagggacggaaaaggagaaaaucaaguucagcuccgagggaucuuucgacccugauggcaagauugugagcuacgaaugggacuuuggggauggcaauaaauccaacgaggaaaaucccgagcauagcuaugacaaggucggaacauacaccgugaaacuuaaggugacagaugacaaaggcgaaucuuccguuagcaccaccacagccgagaucaaggaucucucugagaacaaacugccggucauuuauaugcacgugccuaaguccggggcucugaaucagaagguggucuucuacggaaaaggcacguacgaccccgacgggagcaucgccggauaucagugggauuuuggcgacgggucugauuucagcuccgaacagaacccuagccauguguacaccaagaaaggcgaguauacaguuacccuccgcgugauggacucuuccggacaaaugagcgaaaagacaaugaaaauuaagaucaccgaucccgucuacccuaucggcacggagaaggagcccaauaacuccaaagaaacagcuucugggccgauugugccuggaauccccguuagcggcaccauugagaauaccuccgaccaggauuauuuuuacuucgacgugaucacacccggggaagucaagauugauaucaacaaacugggauauggcggggccaccugggugguuuacgacgagaacaauaacgcggugucuuacgccacagaugacggccagaaucuuagcggaaaguuuaaagcugacaagccuggccgguauuacauccaccuguauauguucaacggguccuacaugccguauagaauuaauaucgaaggaucugucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4279 - RNA, 3413 nt, Artificial Sequence
  mRNA product Design3 comprising derived and/or modified sequence from Clostridium histolyticum__BAA34542.1__ColH (opt5)
gggagagucccgcagucggcguccagcggcucugcuuguucgugugugugucguugcaggccuuauucaagcuuaccaugaagagaaaaugccugagcaagcggcucaugcuggccaucaccauggcuacaauuuucacggugaacuccacccuucccaucuacgccgcggucgacaaaaauaacgcuacagccgccguucagaaugagucuaagcgcuauaccgugagcuaccugaaaacacucaacuauuacgaucugguggaccuucuggucaagaccgaaauugagaaucucccugaucuguuucaauauuccucugacgcuaaggaguucuacggcaacaaaacaagaaugagcuuuaucauggaugaaauugggcggcgcgccccgcaguauaccgaaaucgaccacaagggaauccccacgcugguggagguugugagagcuggcuucuaccucggguuucauaauaaagagcugaacgaaauuaauaagcgguccuucaaagagcgcgucaucccuucuauucuugccauccagaagaaccccaauuuuaagcugggaaccgaagugcaggauaaaauuguuagcgcgacaggccuccuggccgggaacgagaccgcuccucccgagguggucaauaacuucacaccuauccuucaagacuguauuaagaauaucgauagauacgcccuggacgaucucaaauccaaggcucuguuuaacgugcuggccgcgccgaccuaugacaucacggaauaccuccgggccacaaaagagaagcccgaaaacaccccuugguauggaaaaauugauggcuucaucaaugagcugaagaaacuugcucuguacggcaagauuaacgacaauaacagcuggaucauugacaaugggaucuaucacaucgcuccccucggaaagcugcauucuaacaauaaaauuggcaucgaaacacuuaccgaggugaugaaggucuacccuuaucuguccaugcagcaccuccagagcgccgaucagauuaaacgccauuacgacucuaaggaugccgaggggaacaagaucccccuggacaaauuuaagaaagaaggaaaggagaaauacugcccgaagaccuauacauucgaugacggcaagguuauuaucaaagccggggcuagaguggaagaggaaaaggugaaacggcuguacugggcguccaaggaggucaauagccaauuuuuccgcguguauggaaucgauaaaccucucgaggaaggcaaccccgacgauauucugacgaugguuaucuacaauucuccugaggaauauaaacuuaacuccgugcuguacggcuaugacaccaauaacgggggaauguacauugagcccgaaggcacauucuuuaccuacgagagagaggcccaggaaagcacauauacccucgaggaacuguuccggcacgaguacacgcacuaucuucaggggcgcuacgcuguccccggacaguggggcagaacaaagcuguaugauaaugaccggcucaccugguacgaggaagggggagccgagcuguuugccggcuccaccagaacaucuggcauccugccucgcaagagcauuguguccaacauccauaacaccacacggaauaacagauauaagcucagcgacacgguucacucuaaauacggggcuuccuucgaauuuuacaauuaugccuguauguucauggauuacauguauaacaaggacaugggcauucugaauaaacuuaacgaucuggcgaagaauaacgacguggauggauacgacaauuauauccgcgaucucagcucuaacuacgcucugaaugacaaauaucaagaucauaugcaggagcggaucgacaacuacgaaaaucugaccgucccguuuguggccgaugacuaccuugucagacacgccuauaagaaccccaaugagauuuacagcgagaucuccgaaguggcuaagcucaaagaugccaagucugagguuaaaaagagccaguauuucuccacauuuacccugcgcgggagcuacacaggaggcgcuucuaaagggaagcuggaagaccaaaaggccaugaacaaauucauugacgauucccucaagaaacuggacaccuauagcuggucuggcuacaagacgcuuaccgcguauuuuacaaacuacaaaguggauuccagcaaucgggucaccuacgacgugguuuuccacggauaucugccuaacgagggcgauuccaaaaauucucuccccuacgggaagaucaacggaacauauaagggcaccgaaaaggagaaaauuaaguuuagcuccgaggggucuuucgacccugauggaaaaaucgugagcuacgaaugggacuucggcgaugggaauaaguccaacgaggaaaaucccgagcauagcuaugacaaggucggcacguacacagugaaacugaaggugaccgaugacaaaggagaaucuuccguuagcacaaccaccgccgagaucaaggaucugucugagaacaaacuuccggucauuuauaugcacgugccuaaguccggcgcucucaaucagaaaguggucuuuuacgggaagggaacauacgaccccgacggcagcaucgccggguaucagugggauuucggagacggcucugauuuuagcuccgaacagaacccuagccauguguacacgaagaaaggggaguauaccguuacacugagagugauggacucuuccggccaaaugagcgaaaagaccaugaaaauuaagaucacagaucccgucuacccuauuggaaccgagaaagagcccaauaacuccaaggaaacggcuucuggcccgaucgugccugggauccccguuagcggaacaauugagaauaccuccgaccaggauuauuucuacuuugacgugaucacccccggcgaagucaagauugauaucaacaaacugggguauggaggcgccacaugggugguuuacgacgagaauaacaacgcggugucuuacgccaccgaugacgggcagaaucucagcggcaaguucaaagcugacaagccuggacgcuauuacauucaccuguauauguuuaacggcuccuacaugccguaucggaucaauaucgaagggucugucggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4280 - RNA, 3347 nt, Artificial Sequence
  mRNA product Design3 comprising derived and/or modified sequence from Clostridium histolyticum__BAA34542.1__HsALB(1-18)_ColH(41-1021) (opt5)
gggagagucccgcagucggcguccagcggcucugcuuguucgugugugugucguugcaggccuuauucaagcuuaccaugaagugggugaccuucaucagccugcucuuucuguucuccucugccuacagcguccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4281 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt5)
gggagagucccgcagucggcguccagcggcucugcuuguucgugugugugucguugcaggccuuauucaagcuuaccaugaagugggugaccuucaucagccugcucuuucuguucuccucugccuacagcaugaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4282 - RNA, 923 nt, Artificial Sequence
  mRNA product Design3 comprising derived and/or modified sequence from Homo sapiens__NP_001133.1__HsAMELX (opt5)
gggagagucccgcagucggcguccagcggcucugcuuguucgugugugugucguugcaggccuuauucaagcuuaccaugggcaccuggauccuguucgccugccuccugggggcugccuuugcgaugccccuuccuccgcaccccggacauccuggcuacauuaacuucagcuaugaggugcugacaccccucaagugguaccaguccaucagaccucccuauccuucuuacggguaugaaccgaugggaggcuggcugcaccaucaaauuauccccguccuuagccagcagcacccucccacgcauacccugcagccucaccaccauauucccguugugccggcucaacagccugugaucccccagcagccuaugaugcccguccccgggcaacacuccaugacaccuauccagcaucaccagccgaaucugcccccucccgcccagcaaccuuaccagccccagccggugcaaccucagccccaccagccuaugcagccccaaccucccguucauccgaugcagccucucccuccccagcccccgcugcccccuauguuucccaugcagccucugcccccuaugcuccccgaccuuacccuggaggccuggccgucuacagauaaaaccaagcgggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4283 - RNA, 482 nt, Artificial Sequence
  mRNA product Design3 comprising derived and/or modified sequence from Homo sapiens__NP_001133.1__HsAMELX-TRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucaccccucugaagugguaccaguccauuagaccucccuaucccucuuacggauaugaaccgaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4284 - RNA, 515 nt, Artificial Sequence
  mRNA product Design3 comprising derived and/or modified sequence from Homo sapiens__NP_001133.1__HsAMELX-LRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccaguccauuagaccucccccuaugcuuccggaccugacccucgaagccuggcccucuacggauaaaaccaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4285 - RNA, 554 nt, Artificial Sequence
  mRNA product Design3 comprising derived and/or modified sequence from Homo sapiens__NP_001133.1__HLA-A2-SP_HsAMELX(17-60) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuuauccgagcuacggcuaugaacccaugggaggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4286 - RNA, 587 nt, Artificial Sequence
  mRNA product Design3 comprising derived and/or modified sequence from Homo sapiens__NP_001133.1__HLA-A2-SP_HsAMELX(17-47,168-191) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuauucggcccccuccgaugcuccccgaccugacacuggaagccuggccuagcaccgauaaaacaaagcgcgaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4287 - RNA, 926 nt, Artificial Sequence
  mRNA product Design3 comprising derived and/or modified sequence from Homo sapiens__NP_001134.1__HsAMELY (opt5)
gggagagucccgcagucggcguccagcggcucugcuuguucgugugugugucguugcaggccuuauucaagcuuaccaugggcaccuggauccuguucgccugccucgugggggcugccuuugcgaugccccugccuccgcaccccggacauccuggcuacauuaacuucagcuaugagguccuuacaccccugaagugguaccaguccaugaucagaccucccuauucuagcuacggguaugaaccuaugggaggcuggcuccaccaucaaauuaucccgguugugucccagcagcacccccugacgcauacccuucagucucaccaccauauuccugugguccccgcucaacagccucgggugcgccagcaggcccugaugcccguuccggggcaacagagcaugacaccuacccagcaccaucagcccaaucucccucugcccgcccaacagcccuuucagccucaaccggugcagccccagccucaccagcccaugcaaccucagcccccgguccagccuaugcagccccugcucccucaacccccucugcccccgauguucccucuuagaccccugcccccuauccucccggaccugcaccuugaggcuuggcccgccacagauaaaaccaagcaggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4288 - RNA, 485 nt, Artificial Sequence
  mRNA product Design3 comprising derived and/or modified sequence from Homo sapiens__NP_001134.1__HsAMELY-TRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucaccccucugaagugguaccaguccaugauuagaccucccuauucuagcuacggauaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4289 - RNA, 518 nt, Artificial Sequence
  mRNA product Design3 comprising derived and/or modified sequence from Homo sapiens__NP_001134.1__HsAMELY-LRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccaguccaugauuagaccucccccuauccuuccggaccugcaccucgaagccuggcccgcuaccgauaaaacgaagcaagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4290 - RNA, 557 nt, Artificial Sequence
  mRNA product Design3 comprising derived and/or modified sequence from Homo sapiens__NP_001134.1__HLA-A2-SP_HsAMELY(17-61) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuuauagcuccuacggcuaugaaccgaugggaggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4291 - RNA, 590 nt, Artificial Sequence
  mRNA product Design3 comprising derived and/or modified sequence from Homo sapiens__NP_001134.1__HLA-A2-SP_HsAMELY(17-48,169-192) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaucuaugauucggcccccuccgauccuccccgaccugcaccuggaagccuggccugccacagauaaaaccaagcaggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4292 - RNA, 917 nt, Artificial Sequence
  mRNA product Design3 comprising derived and/or modified sequence from Sus scrofa__NP_999071.1__SsAMELX-001-1 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4293 - RNA, 485 nt, Artificial Sequence
  mRNA product Design3 comprising derived and/or modified sequence from Sus scrofa__NP_999071.1__SsAMELX-TRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccagaauaugauuagacacccuuauaccuccuacggauaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4294 - RNA, 518 nt, Artificial Sequence
  mRNA product Design3 comprising derived and/or modified sequence from Sus scrofa__NP_999071.1__SsAMELX-LRAP (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccagaauaugauuagacacccuucccuucugcccgaccucccucuggaagccuggccggcuaccgauaaaacgaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4295 - RNA, 557 nt, Artificial Sequence
  mRNA product Design3 comprising derived and/or modified sequence from Sus scrofa__NP_999071.1__HLA-A2-SP_SsAMEL(17-61) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccuauacaucuuacggcuaugaaccuaugggaggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4296 - RNA, 590 nt, Artificial Sequence
  mRNA product Design3 comprising derived and/or modified sequence from Sus scrofa__NP_999071.1__HLA-A2-SP_SsAMEL(17-49,167-189) (opt5)
gggagagucccgcagucggcguccagcggcucugcuuguucgugugugugucguugcaggccuuauucaagcuuaccauggccgugauggcucccagaacccugguccuccugcuuagcggcgcccuggcgcucacacagacgugggcuaugccucugccgccccacccugggcaucccggauacaucaacuucuccuaugagguucuuaccccucugaagugguaccaaaauaugauucggcaccccucucuccugccugaccugccgcucgaagccuggcccgccacagauaaaaccaagcgcgaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4297 - RNA, 881 nt, Artificial Sequence
  mRNA product Design3 comprising derived and/or modified sequence from Sus scrofa__P45561-2__SsAMELX-001-2 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuauaucagacaccccuacacaucuuauggguacgagccuaugggaggcuggcugcaucaccagauuauccccguggucagccaacagacgccucagucccaugcgcuccagccgcaccaccauauucccaugguuccugcucaacagcccgggaucccucagcagcccaugaugccgcugccuggacaacacucuaugacccccacacagcaucaccagccuaaucuuccccugcccgcccagcaaccuuuucagccgcagcccgugcaaccucagccccaccagccucuccagccccaaagcccgaugcauccuauccagccccugcugccucagcccccucugcccccgauguucuccaugcagucucuccuuccugaccugccccucgaagccuggcccgcuaccgauaagacaaaacgggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4298 - RNA, 917 nt, Artificial Sequence
  mRNA product Design3 comprising derived and/or modified sequence from Sus scrofa__NP_998965.1__SsAMELX-001-3 (opt5)
gggagagucccgcagucggcguccagcggcucugcuuguucgugugugugucguugcaggccuuauucaagcuuaccaugggcaccuggaucuucuuugccugccugcucggggcuagccuggccaugccccuuccuccgcaccccggacauccuggcuacauuaacuucuccuaugaggugcugacaccccucaagugguaccagaauaugaucagacacccuuauacgucuuacggguaugaacccaugggaggcuggcugcaucaccaaauuaucccugucguuagccagcagaccccgcagucccaugcgcuucaaccccaccaccauauuccuauggugcccgcucagcagccugggaucccccagcaaccgaugaugccucugcccggacagcacucuaugacaccuacccagcaucaccagcccaaccucccccugccugcccaacagccguuucagccccaaccugugcagccccagccucaccagccccugcaaccgcagagcccuaugcaucccauccagccucuccugccccagccuccccuuccgccuauguucuccaugcaaucucugcuccccgaccugccccuugaggccuggccugcuacagauaaaaccaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4299 - RNA, 566 nt, Artificial Sequence
  mRNA product Design3 comprising derived and/or modified sequence from Sus scrofa__K7GPB2__SsAMELX-002 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuucucugcuucccgaccugccucucgaagcguggccggcuacggauaaaaccaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4300 - RNA, 959 nt, Artificial Sequence
  mRNA product Design3 comprising derived and/or modified sequence from Sus scrofa__K7GLD0__SsAMELX-003 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggaccuguaccucgaagcgaucagaauugaucggacagcuuuugugcugacgccccuuaagugguaucagaauaugauccgccacccuuacaccucuuauggguacgagcccaugggaggcuggcugcaucaccaaauuaucccugucguuagccagcagacaccgcagucccaugcccuccaaccccaccaccauaucccuauggugcccgcccagcagccugggauuccccagcaaccgaugaugccucugcccggacagcacucuaugaccccuacacagcaucaccagcccaaccugccccucccugcucaacagccguuccagccccaaccugugcagccccagccucaccagccccugcaaccgcagagcccuaugcaucccauccagccucuucugccccagccuccccucccgccuauguuuuccaugcaaucucugcuucccgaccugccccucgaagccuggccugcuaccgauaaaacaaagagagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4301 - RNA, 845 nt, Artificial Sequence
  mRNA product Design3 comprising derived and/or modified sequence from Sus scrofa__K7GPE9__SsAMELX-004 (opt5)
gggagagucccgcagucggcguccagcggcucugcuuguucgugugugugucguugcaggccuuauucaagcuuaccaugggcaccuggauccuguucgccugccuccugggggcugccuuuagcaugccccuuccuccgcaccccggacauccuggcuacauuaacuucuccuaugaggugcugacaccccucaagugguaccagaauaugaucagacacccuacgccccaaucucaugcgcugcagccucaccaucacauuccgaugguccccgcucagcagccugggaucccccaacagccuaugaugccccuuccgggacagcacagcaugaccccuacacagcaucaccaacccaaccugccucuccccgcccagcagcccuuucagccucaaccgguucagccccagccucaucaaccccugcagccucagucccccaugcacccgauucagccucugcucccccaaccuccccugccucccauguucucuaugcagagccuucugccggaccucccucuggaagccuggcccgcuaccgauaaaacaaagcgggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4302 - RNA, 869 nt, Artificial Sequence
  mRNA product Design3 comprising derived and/or modified sequence from Sus scrofa__J9JIM4__SsAMELX-201 (opt5)
gggagagucccgcagucggcguccagcggcucugcuuguucgugugugugucguugcaggccuuauucaagcuuaccaugccccugccuccgcaccccggccauccuggguacaucaacuucagcuaugaggugcucacaccccugaagugguaccagaauaugauuagacacccuuauaccuccuacggauaugaacccaugggcggguggcuucaucaccaaaucauuccugucguuucucagcagacgccgcagagccaugcccugcaaccccaccaccauaucccuauggugcccgcucagcagccuggcauuccccagcaaccgaugaugccucuccccggacagcacuccaugaccccuacacagcaucaccagcccaaccugccccuuccugcccaacagccguuucagccccaaccugugcagccccagccucaccagccccugcaaccgcagucuccuaugcaucccauccagccucuccugccccagccuccccugccgccuauguucagcaugcaaucccuccugcccgaccuuccccuggaggcguggccugcuaccgauaaaacaaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4303 - RNA, 3308 nt, Artificial Sequence
  mRNA product Design3 comprising derived and/or modified sequence from Homo sapiens__NP_006120.1__HsBMP1 (opt5)
gggagagucccgcagucggcguccagcggcucugcuuguucgugugugugucguugcaggccuuauucaagcuuaccaugcccggcguggccagacugccucuccugcuugggcugcuccugcuuccgcggcccggacgcccucuggaccucgcugauuacaccuaugaccuggccgaggaagaugacagcgagccccugaacuacaaggauccuugcaaagcggcugccuuccucggcgacaucgcccuggaugaagaggaccuuagagcuuuucagguccaacaggccguugaucugcggcgccacacagcuagaaaguccucuauuaaagccgcggugcccgggaauacgagcaccccuuccugucagucuacaaacggacagccgcaacggggcgccugcgggcgcuggagaggacggagccgcuccagacgggcugccaccucucgccccgaaagaguguggccugacggcgucauccccuucgugauuggcgggaauuuuacaggaagccagcgggcuguuuuccgccaggccaugagacauugggagaagcacaccugugugacauuucucgagcggaccgaugaagacuccuauaucgucuucacguacagaccuugcggcuguugcagcuauguggggcgccggggaggcgggccccaggcgauuucuaucggaaagaacugugauaaguuuggcaucguugugcaugagcugggccacgucgugggguucuggcaugaacacaccagaccggaccgcgaccggcacguguccauugucagagagaauauccaaccuggacaggaguacaacuuucuuaagauggaaccccaggagguugaaagccugggcgagacauaugauuucgacucuauuaugcauuacgcccgcaauaccuuuucccgggggaucuuccucgauacaauugugccuaaauacgaagugaacggagucaagccucccaucggccagagaacccgccugagcaaaggggacauugcucaagcccggaagcuguauaaaugccccgcuuguggagagacgcuccaggauucuacaggcaauuuuuccagcccggaguaccccaacggcuauuccgcccacaugcauugcguguggagaaucucuguuaccccuggggaaaagaucauucugaauuucacaagccuugaccuguaccgcucccggcucuguugguaugauuacguggaggucagagacggauucuggcggaaggcuccccugcgcggcagauuuugcgggagcaaacuuccugaacccaucgugucuaccgauucccggcuguggguugaguucagaagcucuagcaacugggugggaaagggcuuuuucgccgucuaugaagcgauuugcgggggcgacgugaaaaaggauuacggacacauccaguccccgaauuacccugacgacuaucgccccucuaaagucuguauuuggcggauccaagugagcgagggcuuucacguugggcucaccuuccaguccuuugagaucgaaagacaugauagcugcgccuacgacuaucuggaggugcgcgauggacacucugaauccagcacacugauuggcagauacuguggguaugagaagccugacgauaucaaaucuacguccagccggcucuggcugaaguucgucuccgacggaucuauuaacaaggcuggcuuugccgugaauuucuuuaaagaaguugaugagugcagccgccccaacagagggggcugugagcagcggugccuuaacacccugggauccuacaaguguucuugcgacccuggcuaugaacucgcccccgauaaacgcagaugugaggcugccugcgggggauuccugacaaaacuuaauggcagcaucaccuccccgggguggccuaaagaauacccucccaacaagaauuguauuuggcagcugguggcgcccacacaauaccggaucagccuccaguuugacuucuucgagaccgagggaaacgaugucugcaaguaugacuuuguggaagugcgcucuggccugacggcugauuccaaacugcaugggaaguucugcggcagcgagaaaccggaaguuaucacaucucaguacaauaacaugagagucgaguuuaaguccgacaauaccgugagcaaaaagggauucaaggcccacuuuuucucugacaaagaugaauguagcaaggacaacggcgggugccagcaagauugugugaauaccuuuggauccuaugagugccagugucggagcggcuucguccuccaugacaacaaacacgauugcaaggaggccgggugugaccacaaagugacaucuaccuccggaacaauuacgagccccaauuggccugauaaguaccccuccaagaaagaaugcaccugggcuaucucuagcacaccuggccaucgcguuaagcugaccuuuauggagauggacauugaaucccagcccgagugugccuaugaucaccuugaaguguucgacgggagagaugcuaaagccccuguccugggccgguuuugcggaucuaagaaacccgagccggugcucgcgacaggcagcagaauguuccugcgcuuuuacuccgacaacucuguucagcggaagggguuccaagccagccaugcuaccgaguguggaggccaggugagagccgaugucaaaacgaaggaccuguauucccacgcucaguucggggacaauaacuacccuggaggcguggauugcgaauggguuaucguggccgaggaaggcuacggggucgagcuuguguuucagaccuucgaaguggaggaggaaacagacugcggauaugauuacauggagcucuuugacggcuaugauagcaccgcgccccgccuggggcgguacuguggaucuggcccucccgaagaggucuauuccgccggggacagcguucuggugaaguuccacucugaugacacaauuaccaaaaagggauuucaucucagauacacguccacaaaauuccaagauacccugcacagccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4304 - RNA, 1538 nt, Artificial Sequence
  mRNA product Design3 comprising derived and/or modified sequence from Homo sapiens__NP_001191.1__HsBMP2 (opt5)
gggagagucccgcagucggcguccagcggcucugcuuguucgugugugugucguugcaggccuuauucaagcuuaccaugguggccggcaccagaugccugcucgcucugcuucugccccagguccuccuugggggagccgcgggccugguuccugagcuggggcggcgcaaguucgcugccgccagcuccggaagaccgucuagccaacccuccgacgaagugcucucugaguuugaacugcggcugcucagcauguucggccugaaacagcgcccuacacccuccagagaugcuguggucccucccuacaugcuugaccuguaucggcgccacucugggcagccuggaagcccggcccccgaucauagacucgagcgggcugccucccgcgcgaacacggugagaucuuuucaccaugaagagucucuggaggaacuuccugagaccuccggcaagacaacccggcgcuucuuuuucaaucugagcucuauccccacagaagaguuuauuaccuccgccgagcuccagguuuucagagaacaaaugcaggacgcucugggcaacaauagcucuuuucaccaucggaucaacauuuacgagaucauuaaaccugccacagcuaauuccaaguuccccgugacccgccugcucgauacgagacuggucaaccagaaugccagccggugggaauccuuugacgugaccccggcgguuaugagauggacagcccaggggcacgcuaaccacggauucguggucgagguggcccaucuugaagagaaacaaggcgugucuaagcgccacguccggaucagcagaucccugcaucaggaugagcacagcuggucucagauccgcccucuccugguuaccuuugggcacgacggaaagggccauccccuucacaaacgggaaaagagacaggcuaaacauaagcaacgcaaacggcugaaguccagcuguaagagacacccucucuauguggauuucucugacgugggguggaaugauuggauugucgccccucccggauaccaugccuucuauugccacggcgagugucccuuuccgcuggcugaccaccugaacagcacaaaucaugcgaucgugcagacccucguuaacuccgugaauagcaaaauucccaaggccugcugugucccuacggaacugagcgcuaucuccaugcuuuaccuggaugagaacgaaaaagugguucucaagaauuaucaggacaugguggucgagggcugcgggugucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4305 - RNA, 1574 nt, Artificial Sequence
  mRNA product Design3 comprising derived and/or modified sequence from Homo sapiens__NP_001193.2__HsBMP4 (opt5)
gggagagucccgcagucggcguccagcggcucugcuuguucgugugugugucguugcaggccuuauucaagcuuaccaugauccccggcaacagaaugcugauggugguccuccugugccagguucuucucgggggagccagccacgcuucccugauuccugagaccggcaagaaaaagguggccgaaauccaagggcaugcgggaggccggcgcucugggcagagccacgagcugcuuagagacuucgaagcuacacugcuccagauguuuggacugcggcgcagaccgcagcccuccaaaucugccgugauuccugauuacaugcgggaccuguaucgccuccaaagcggcgaggaagaggaggaacagauccauuccacgggccuggaguaccccgaaagaccugccucucgggcuaauaccguccgcagcuuccaccaugaggagcaccuugaaaacauucccgggacauccgagaauagcgccuuuagauuccuguuuaaccucucuuccaucccugaaaaugaggugaucagcucugcugaacugcggcuuuuccgcgagcagguugaucagggaccggacugggagagaggcuuucaccggauuaacaucuaugaagugaugaagcccccugccgaggucgugcccgggcaucugauuacccgccuccuggauacaagacugguucaccauaaugugacccggugggaaacauucgacgucuccccugcggugcucagauggacccgcgagaaacaacccaacuacggacuggccaucgaagugacgcaccuucaccagacccggacacaucagggccagcacgucagaauuagccgcucucugccgcaaggguccggaaauugggcucagcuccggccucugcuuguuaccuuuggccaugauggcagagggcacgcccugacacgccggagacgcgcuaagcggagccccaagcaucacucccagagagcccgcaaaaagaacaaaaauugucggagacacucucucuauguggacuucagcgaugugggauggaacgacuggaucgucgcgccucccggcuaccaagccuuuuauugccauggggauugucccuucccucuggcugaccaccucaauuccaccaaccaugccauugugcagacgcugguuaauagcgugaacucuuccaucccgaaggcuugcuguguccccacagagcugagcgccaucucuaugcuuuaccuggaugaguacgacaaagugguucucaagaacuaucaggaaaugguggucgagggaugcggcugucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4306 - RNA, 1889 nt, Artificial Sequence
  mRNA product Design3 comprising derived and/or modified sequence from Homo sapiens__NP_001709.1__HsBMP6 (opt5)
gggagagucccgcagucggcguccagcggcucugcuuguucgugugugugucguugcaggccuuauucaagcuuaccaugcccggccuggggagacgggcccaguggcucugcuggugguggggacugcuuuguagcugcuguggcccuccgccccugcgcccuccccucccugcugccgcggcugccgccgcugggggacaacugcuuggcgacgggggaucccccggcagaaccgagcagccuccgcccucuccucagagcuccucuggcuuccuguaccggcgccucaagacacaggagaaaagagaaaugcaaaaggaaauccugagcgugcuggggcucccccaccggccucgcccccugcauggacuucagcagccgcagccucccgcccugagacaacaggaggaacagcagcaacagcagcaacucccucggggcgagcccccucccgggcgccugaaauccgcuccgcuuuuuaugcuggaucucuauaacgcccugucugcggacaaugaugaggacggagccagcgaaggcgagagacagcaguccuggccccacgaagcugccuccucuucccagcggcgccaaccucccccuggggcugcccauccccugaacagaaagagccuccuggcgccgggaucuggcuccggcggggccagcccucuuacgucugcucaggauuccgccuuccugaaugacgcugauauggucaugagcuuuguuaaccucguggaguacgacaaagaguucagcccccggcagcgccaccauaaggaauuuaaguucaaucugucucagauuccugagggagaaguggucaccgccgccgaguuuagaaucuauaaagauugcgugaugggcagcuucaagaaccaaacauuucuuauuuccaucuaccagguucugcaggaacaccagcaccgggacagcgaucucuuccugcuggacaccagaguggucugggcuucugaggagggguggcucgaauuugauauuacagcgaccuccaaucugugggugguuacaccccaacauaacaugggacuucagcugagcguggucacccgcgacggcgugcacgugcauccucgggccgcugggcucgucggaagagacggccccuaugauaaacagccguucaugguugccuuuuucaaggugucugaggugcacguccgcacgacccggagcgccuccucuagacgccggcagcaaagcagaaaucgcuccacacagagccaggacguggcucggguuucuuccgccagcgauuacaacucuuccgaacugaaaaccgcguguagaaagcacgagcuuuaugugagcuuccaagaccugggcuggcaggauuggaucaucgcuccuaagggguacgccgccaauuacugcgacggagaauguuccuuuccccucaacgcucauaugaaugccacaaaccacgcuauuguccagacccuggugcaucugaugaaucccgaguauguuccuaaaccgugcugugcccccacgaagcucaacgcgaucucugugcuguacuucgaugacaacagcaaugucauucuuaaaaaguaucgcaacauggugguccgggccugcggcugucacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4307 - RNA, 1643 nt, Artificial Sequence
  mRNA product Design3 comprising derived and/or modified sequence from Homo sapiens__NP_001710.1__HsBMP7 (opt5)
gggagagucccgcagucggcguccagcggcucugcuuguucgugugugugucguugcaggccuuauucaagcuuaccaugcacgugagaagccugcgggccgcugcuccccauuccuucgucgcgcucugggcuccucuguuucuucugcgcucugcccucgccgacuucagccuggauaacgagguucacuccucuuuuauccauagacggcuucgcagccaggaaagacgggagaugcaacgcgaaauucuguccauccucggccugccgcacagaccccggccucaucugcaggggaagcacaauucugcucccauguucaugcucgaccuguacaacgccauggcuguggaggaaggaggcgggccuggaggccagggguuuagcuaucccuacaaagccguguucuccacccagggaccuccgcuugcgagccugcaagauucucacuuucucacagacgccgauauggucauguccuucgugaaucugguugagcaugacaaggaguuuuuccacccccgcuaucaucacagagaauuucgguucgaucuuagcaaaauuccugagggcgaagcugugacggccgcugaguuucgcaucuacaaggacuauauuagagagcgguucgauaacgaaaccuuccgcaucucugucuaccaggugcugcaggagcaccucggcagagaauccgaccuguuucugcucgauagccggacacugugggccucugaggaaggguggcuuguuuucgacaucaccgcgacauccaaucauuggguggucaaccccagacacaaucugggacuccagcugagcguggagacccuugauggccaauccauuaacccuaaacuggccgggcucaucggacgccauggcccccagaauaagcagccguuuaugguggcuuucuuuaaggccacagagguccacuuccggucuauuagaagcaccggguccaaacagcgcagccaaaaccggucuaagacgccuaaaaaucaggaagcucugagaauggccaacguugccgaaaauuccagcucugaccagcgccaagccugcaagaaacaugagcuguaugugagcuuucgggaccucggauggcaggauuggaucauugcgcccgagggcuacgccgcuuacuauugugaaggcgagugcgccuucccucugaacuccuacaugaaugccaccaaccacgcuaucgugcagacacuuguccacuuuauuaaccccgagaccgugcccaagccuuguugcgccccgacacagcugaaugcgaucucuguucucuauuucgacgauagcuccaacgugauccugaagaaauacagaaauauggucgugcgcgcuugugggugccauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4308 - RNA, 647 nt, Artificial Sequence
  mRNA product Design3 comprising derived and/or modified sequence from Homo sapiens__NP_006264.2__HsCCL7 (opt5)
gggagagucccgcagucggcguccagcggcucugcuuguucgugugugugucguugcaggccuuauucaagcuuaccaugaaggccagcgcugcccugcucugccugcuucugaccgcggcugccuucucuccccagggccucgcccaaccuguggggaucaacacauccacgaccuguugcuacagauuuauuaauaaaaagaucccgaaacagcggcuggagagcuaucgcagaacaaccuccucucacuguccccgggaagcugucauuuucaagacaaaacuugacaaggagaucugcgccgauccuacccagaaguggguucaggacuuuaugaaacaucuggauaagaaaacacaaacccccaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4309 - RNA, 3971 nt, Artificial Sequence
  mRNA product Design3 comprising derived and/or modified sequence from Homo sapiens__NP_001954.2__HsEGF (opt5)
gggagagucccgcagucggcguccagcggcucugcuuguucgugugugugucguugcaggccuuauucaagcuuaccaugcugcucacccugaucauucuucugcccguggucagcaaguucuccuuuguuucucucagcgccccucagcacugguccugcccggagggcacacuggcugggaacggaaauucuacgugugugggccccgccccuuuccuuaucuuuagccaugggaacuccauuuucagaaucgacaccgaaggaacaaauuacgagcaacugguggucgaugcgggcgugucuguuauuauggacuuucacuauaacgaaaaacggaucuacuggguggaucucgagcgccagcugcugcagagagucuuccucaaugggagccggcaggaacgcgugugcaacaucgagaagaauguuuccggaauggcuauuaacuggaucaaugaggaagugauuuggagcaaccaacaggagggcaucauuaccgucacagacaugaaaggcaauaacucucauauccugcuuuccgcccugaaguaucccgccaauguggcuguggauccugucgaaagauuuauuuucuggagcucugagguugccgggucccucuaccgggcugaccuggauggagugggcgugaaagcccuucuggagaccagcgaaaagaucacagcggucucucucgacgugcuggauaagcgccuguuuuggauccaguauaacagagagggguccaauagccucauuuguuccugcgacuacgauggaggcucuguucacaucagcaaacaucccacccagcacaaccuguucgccaugucccuuuuuggggaccggauuuucuauagcacguggaagaugaaaaccaucuggauugcuaacaagcacacaggaaaagauauggugcgcaucaaucugcauucuuccuuugucccucucggcgaacugaaggugguucacccgcuugcccaacccaaggcugaggacgacaccugggaaccugagcagaaacuguguaagcucagaaaaggcaacugcagcucuacagugugugggcaggaucugcagagccaucugugcaugugugccgagggauacgcgcucucccgggaccgcaaguacugcgaagaugucaaugagugugccuucuggaaccacggcugcacccuggggugcaaaaauacgcccggaucuuauuacuguacaugcccugugggcuucguccuucugcccgacgggaagagaugucaccaacucgugagcugcccgcggaacguuuccgaauguagccaugauugcgugcugaccucugagggaccucuuuguuuuugccccgaaggcuccguccuggagcgcgacggcaaaacauguagcggguguucuuccccugauaauggaggcugcagccagcucugcgugccccugucccccguuucuugggagugcgacuguuucccuggguaugaucugcagcucgacgaaaagagcugcgcugccuccggaccgcaacccuuucugcuuuucgcuaacucucaggauaucagacacaugcauuuugacggcaccgacuacgggacccugcucagccagcagaugggcaugguguaugcccuggaucacgacccugucgagaauaagauuuacuucgcccauacagcucugaaauggaucgaacgggcgaacauggauggaucccaaagagagcgccuuauugaagagggcguggacgugcccgaggggcucgccguugauuggaucggacggagauuuuauuggacggaccgcggcaagagccugauugggcggucugaucugaauggaaaaagauccaagaucaucaccaaagaaaacauuagccagccucgcggcaucgcuguccaccccauggccaagcggcuuuucuggacagacaccgggauuaauccgagaaucgagucuuccagccugcagggccuuggacgccuggugauugccucuagcgaucucaucuggccuuccggcauuacaaucgacuuucugaccgauaagcuguacuggugugacgcuaaacagagcgugaucgaaauggccaaccuugaugggucuaagcggagacgccucacgcaaaaugacgucggacaccccuucgcgguggcuguuuuugaggacuacgugugguucuccgauugggccaugccuagcgucaugcgggugaacaaaagaacaggcaaggaccggguucgccugcagggguccaugcugaaacccucuagccucguggucgugcauccucuggccaagcccggagcugauccgugccuuuaucagaacggcgggugugagcacauuugcaagaaaagacugggcaccgccugguguuccugccgggaaggauuuaugaaggcuucugacggcaaaaccugucucgcccuggaugggcaucagcugcuugcgggaggcgagguugaccucaagaaucaagugacaccucuggauauccugagcaaaaccagagucuccgaagacaacauuacagagucucagcacaugcucguggccgaaaucauggugagcgaucaggacgauugcgcucccgucggguguuccauguacgcccgcugcauuagcgagggagaggacgcuacgugccagugucugaagggcuucgccggggauggcaagcucugcucugacaucgacgaaugugagaugggaguucccgugugcccuccggcguccagcaaauguaucaauaccgaaggcggguaugugugccgguguucugagggauaccaaggcgaugggauucacugccuggacaucgaugaaugucagcucggagagcauuccugcggcgagaacgccagcuguacaaauaccgaaggcggguauacaugcaugugcgcuggaagacugucugagcccggccugauuuguccugacuccacgcccccuccccaccuucgcgaagaugaccaucacuacagcgucagaaacuccgauagcgagugcccucucucucaugacggguauugucugcacgauggagugugcauguacaucgaagcccuggacaaguacgcuuguaauugcguugugggcuauauuggggagcggugucaguaccgcgaucucaaauggugggagcugagacacgccggacauggccaacagcagaaggucaucgugguugccgugugcgucgugguucuugugaugcugcuccugcugagccuuuggggcgcucacuauuaccggacccagaaacugcucuccaagaaccccaaaaauccguaugaagagucuagccgcgacgucagaucccggcgcccugcggacaccgaagaugggaugucuagcuguccccaaccuugguucguggugaucaaggagcaucaggaccugaagaacggaggccagcccgucgccggggaggauggacaggcugccgacggcuccaugcaaccgacaucuuggagacaggaaccucagcucugcgggaugggaaccgagcagggcuguuggauucccguuagcuccgauaaaggcagcugcccucaagugauggaacggucuuuucacaugcccuccuacgggacacagacccuggagggaggcguggaaaagccccauagccuucugucugccaauccucucuggcagcaacgcgcucuggacccgccccaccagauggagcugacgcagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4310 - RNA, 857 nt, Artificial Sequence
  mRNA product Design3 comprising derived and/or modified sequence from Homo sapiens__NP_001423.1__HsEREG (opt5)
gggagagucccgcagucggcguccagcggcucugcuuguucgugugugugucguugcaggccuuauucaagcuuaccaugaccgccggcagacggauggagaugcugugcgcugggcgcgugcccgcccuccugcuuugucugggauuccaccuccugcaggcgguccuuagcacaacgguuaucccuuccugcauuccgggcgaaucuagcgacaacuguaccgcucuggugcaaacagaggauaaucccagaguggcccaggucuccaucaccaagugcucuagcgacaugaacggguacugucuccauggacagugcauuuaucugguggauaugucccagaauuacugucggugcgaaguuggcuauacaggggugcgcugugagcacuuuuuccugaccguccaucaaccucucucuaaagaauacguggcccugacaguuauccuuauuauccuguuucucaucaccguggucggaagcacguauuacuucugcagaugguaucggaaccgcaaguccaaagagcccaagaaagaguacgaaagagugaccagcggcgacccugagcugccccaggugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4311 - RNA, 815 nt, Artificial Sequence
  mRNA product Design3 comprising derived and/or modified sequence from Homo sapiens__NP_000791.1__HsFGF1 (opt5)
gggagagucccgcagucggcguccagcggcucugcuuguucgugugugugucguugcaggccuuauucaagcuuaccauggccgagggcgaaaucaccacauucacggcucugaccgagaaguuuaaccugcccccugggaauuacaaaaagccgaaacuccuuuauugcagcaacggaggccacuuccugcggauucuccccgacgggacaguggauggaaccagagaccgcuccgaucagcauauccaacugcagcuuucugccgaaagcgucggcgagguuuacauuaaguccacagaaaccgggcaguaucuggcgauggacacagauggacuccuguacggcucucagaccccuaaugaggagugucuguuucucgaaagacuggaggaaaaccacuauaauacguacaucagcaaaaagcaugcugagaagaacugguucgugggccuuaaaaagaauggguccugcaaacggggaccccgcacccacuauggccaaaaggccauucuguuucucccucugcccgugucuagcgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4312 - RNA, 1214 nt, Artificial Sequence
  mRNA product Design3 comprising derived and/or modified sequence from Homo sapiens__NP_001997.5__HsFGF2 (opt5)
gggagagucccgcagucggcguccagcggcucugcuuguucgugugugugucguugcaggccuuauucaagcuuaccauggugggcgucgggggaggcgacguugaggaugugacccccagaccugggggaugccagaucagcggccgcggggcccggggauguaacggcauuccgggcgcugccgcgugggaagcugcccugcccagacggcgcccuagacggcaccccuccgugaauccucgcucuagagccgcugggagcccccggacacgcggaagacggacggaggaacgcccuuccggcucuagacucggggaccggggacgcggcagagcccugcccgggggacggcuuggcggcagagggcgcggacgggcucccgagagagucggcgggcgcggacggggcagagggaccgccgcgccucgcgccgcucccgccgcucggggaagcagaccuggccccgccggcacaauggcggccggguccaucaccacacugccggcucucccugaagauggaggcucuggggccuucccgccuggacauuuuaaggaccccaaacgccuguacugcaagaacggcggguucuuucuucggauucaccccgauggcagaguggacggaguucgcgagaaaagcgauccucauaucaagcugcaacuccaggcugaggaacggggcguggucuccauuaaaggggugugugccaauagauaucuggccaugaaggaggacggacggcugcucgcuagcaagugcguuaccgaugaauguuucuuuuucgagcgccuggagucuaacaauuacaacacauauagaucccggaaauacaccagcugguauguggcgcuuaagagaacgggccaguacaaacuggggucuaagaccggaccgggccagaaagccauccucuuucugcccauguccgcuaagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4313 - RNA, 932 nt, Artificial Sequence
  mRNA product Design3 comprising derived and/or modified sequence from Homo sapiens__NP_002000.1__HsFGF7 (opt5)
gggagagucccgcagucggcguccagcggcucugcuuguucgugugugugucguugcaggccuuauucaagcuuaccaugcacaaguggauccugaccuggauucuccccacacugcuuuacagaagcugcuuccauaucauuugucuggugggcacgaucucccucgccugcaacgacaugaccccugagcagauggcuacaaaugucaacuguucuagcccggaacggcacacccgcuccuaugauuacauggaagggggagacauuagaguucggcgccuguuuugcagaacacaaugguaucuucggaucgauaaacgcggcaaggugaaagggacccaggagaugaagaauaacuacaauaucauggagauuagaacaguggccgucggaaucguggcgauuaaaggcguugaaucugaguucuaucuggcuaugaacaaggaggggaagcucuacgccaaaaaggaauguaaugaggacugcaacuuuaaagaacugauccuggagaaucauuauaacaccuacgccagcgcuaaguggacgcacaauggaggcgagauguucguggcccucaaccagaaaggcauucccguccgggggaagaagaccaaaaaggaacagaaaacagcucauuuucugccuauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4314 - RNA, 974 nt, Artificial Sequence
  mRNA product Design3 comprising derived and/or modified sequence from Homo sapiens__NP_001936.1__HsHBEGF (opt5)
gggagagucccgcagucggcguccagcggcucugcuuguucgugugugugucguugcaggccuuauucaagcuuaccaugaagcugcuccccagcgugguccugaaacuuuuccuggccgcuguucucuccgcccuggugaccggcgagucucuugaaagacugcggcgcgggcucgcggcuggaacaagcaacccugacccgcccacgguguccaccgaucagcugcugccucucggcgggggaagagaccggaagguccgcgaucugcaagaggccgaccuugaucugcucagagugacacugucuagcaaaccccaggcccuugcuaccccuaauaaggaggaacacggcaaacggaagaagaaagggaagggacugggcaaaaagcgcgaccccugccucagaaaauacaaggauuuuuguauccauggcgaaugcaaguauguuaaagagcugcgggccccuuccuguauuugccacccgggguaccauggagagcgcugucacggccugucucuccccguggaaaacagacuguauacauacgaccauaccacaauccuugcugucguggccguugugcugagcuccgucugccuccuggugauuguggggcuucugauguuccgguaucaccgcagaggaggcuacgaugucgagaaugaagagaagguuaaacucgggaugaccaacagccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4315 - RNA, 2534 nt, Artificial Sequence
  mRNA product Design3 comprising derived and/or modified sequence from Homo sapiens__NP_000592.3__HsHGF (opt5)
gggagagucccgcagucggcguccagcggcucugcuuguucgugugugugucguugcaggccuuauucaagcuuaccaugugggugaccaagcugcuccccgcccugcuucugcagcacguccuccugcaucuucugcuccugccuaucgcuauuccguacgccgagggccaaagaaaacggcgcaacacaauccacgaguucaagaaaagcgcgaagacgacccugauuaaaaucgaccccgcucucaagauuaagaccaaaaagguuaauaccgccgaucagugcgccaacagauguacacggaauaaagggcugccuuuuaccugcaaggcuuucguguuugacaaagcccgcaagcagugucuuugguuccccuuuaacuccaugucuagcggagugaagaaagaguucggccaugaauuugaucuguaugagaauaaggacuacaucagaaacugcaucauugggaaaggacgguccuauaagggcacagucucuaucaccaaaagcgggauuaagugucagccuugguccucuaugaucccccacgaacauagcuuccucccuuccagcuaccgcggaaaagaucugcaagagaauuauugcagaaacccgcggggcgaggaaggcgggcccugguguuuuacgucuaauccugaggugcgcuacgaaguuugcgacauuccccaguguuccgagguggagugcaugaccuguaacggagaaagcuauagaggccuuauggaucacacagagucugggaagaucugccagcggugggaccaccagaccccucaucgccacaaguuccugcccgaaagauacccggauaaaggauuugacgauaauuacugccggaacccugacggccaaccccgcccuugguguuauacacucgauccccauacaagaugggaauacugcgcuauuaagacgugugccgacaauacaaugaacgacaccgaugucccccuggaaacaaccgagugcauccaggggcagggagagggcuaucggggcaccgugaauacaaucuggaacgggauuccuugucagagaugggacucccaauacccgcacgaacacgauaugacgcccgagaacuucaaaugcaaggaccugcgcgaaaauuauugucggaacccugauggaagcgagucucccuggugcuuuaccacagacccuaauaucagaguuggcuacuguucccagauucccaacugcgauaugagccaugggcaggacuguuaucgcggaaauggcaaaaacuacauggggaaucucucccaaacccggucuggacugacaugcagcaugugggauaagaacauggaagaccuucacagacauaucuucugggagccggaugcguccaagcugaaugagaacuacugccgcaauccugacgacgaugcccacggccccugguguuauaccggcaacccucucauucccugggacuacugcccuaucagccggugugaaggggauacgacacccaccaucgugaaucuggaccauccggucauuucuugcgcuaaaaccaagcagcuuagaguggugaacggaaucccuacacgcaccaauauuggcuggauggucucccugcgguauagaaacaaacacaucugugggggaagccucauuaaggagucuuggguucugacagcccgccagugcuuccccagccgggaucugaaagacuacgaggcuuggcucggcauccacgaugugcaugggagaggcgacgaaaaguguaaacaggugcugaacgucucccaacuuguguauggacccgaaggcucugaucugguucucaugaagcuggcccggccugcggugcuugacgauuuugucagcacgaucgaccugccgaauuacgggugcaccauucccgagaagacauccuguagcguguauggauggggcuacaccgggcucaucaacuacgauggacugcugcgcguugcccaccucuauauuaugggcaaugagaaaugcucucagcaucacagagggaaggugacacugaacgaauccgagaucugugcuggcgccgagaaaauuggaagcggcccuugcgaaggggacuacggaggcccccuugucugcgagcagcacaagaugcggauggugcugggggucaucgugccuggaagaggcugugcuauucccaaucgcccugggaucuucguucggguggccuauuacgccaaguggauccauaaaauuauccucaccuauaaggucccccagucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4316 - RNA, 2273 nt, Artificial Sequence
  mRNA product Design3 comprising derived and/or modified sequence from Homo sapiens__NP_005336.3 __HsHSPA1A (opt5)
gggagagucccgcagucggcguccagcggcucugcuuguucgugugugugucguugcaggccuuauucaagcuuaccauggccaaggcugccgcgaucggcauugaccuggggaccacauacagcugcgugggagucuuccagcacggcaaaguugagaucauugcuaacgaucaagggaauagaacgacccccuccuauguggccuuuacagacaccgaacggcucaucggagaugccgcuaagaaccagguggcccugaauccucagaacacagucuucgacgcuaaacgccuuauuggcagaaaguuuggggauccggugguucagucugacaugaaacauuggcccuuccaagugaucaaugauggagacaagccuaagguccaggugagcuacaaaggcgagaccaaggccuuuuaucccgaagagaucuccucuaugguucugacaaaaaugaaggaaauugcggaggccuaccucggcuauccugugaccaacgcugucaucacggugcccgccuacuucaaugauagccagcggcaggcuaccaaagacgccggggugauugcgggacugaacguccuucgcaucauuaaugagccuacagccgcugccaucgcuuauggccuggauagaaccgggaagggagaacggaacguucucauuuuugaccugggcgggggaacauucgauguguccauccugaccaucgacgacggcauuuuugaggugaaggccacggccggcgauacacaccucgggggagaagacuucgauaaucgccuggucaaccauuuuguggaggaguucaaaagaaagcacaaaaaggacaucucucaaaauaaacgggcuguucgcagacuucggaccgcgugugaacgcgccaagagaacacugagcuccagcacccaggcuucucucgagauugauucccuguuugaaggcaucgacuucuacaccagcauuacacgggcccgcuucgaggaacuuugcucugaucuguuuagauccacgcucgagccgguggagaaagcccugcgggacgcuaagcuggauaaggcccagauccaugaccucguccugguugggggaagcaccagaauccccaaagugcagaaacuucugcaagauuucuuuaacggccgcgaccucaauaagucuauuaacccugacgaagcgguggcuuacggggccgccguccaggcugccauccugaugggagauaaguccgagaacgugcaggaccuucugcuccuggaugucgcuccccugagccucggccuggaaacagccggcggggugaugaccgcgcuuauuaaacggaauagcacaaucccuaccaagcaaacgcagauuuucacaaccuauucugacaaccagcccggaguucugauccagguguacgagggcgaaagagccaugaccaaggauaauaaccuccuggggcgcuuugagcuuagcggaaucccgccugcuccccggggcgucccucaaauugaggugacauucgacaucgaugccaaugggauucugaacguuaccgcuacagacaaauccacgggcaaggccaauaaaaucaccauuacaaacgauaagggaagacucagcaaagaagagaucgaacgcauggugcaggaggcggaaaaguauaaggccgaggacgagguccagcgggaaagagugucugcuaaaaaugcccuggaguccuacgcuuuuaacaugaaguccgccguggaagaugagggccugaaagggaagauuucugaggccgacaaaaagaagguucucgauaaaugucaggaagucaucagcuggcuggacgcuaauacccuugcggagaaggacgaguucgaacacaaacgcaaggaacuggagcaagugugcaaccccaucauuuccggacucuaucagggcgccgggggacccggcccugggggcuuuggagcucagggcccgaaagggggaucuggcagcgggcccacaaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4317 - RNA, 2273 nt, Artificial Sequence; identical to SEQ ID NO: 4316
  mRNA product Design3 comprising derived and/or modified sequence from Homo sapiens__NP_005337.2 __HsHSPA1B (opt5)

SEQ ID NO: 4318 - RNA, 2273 nt, Artificial Sequence
  mRNA product Design3 comprising derived and/or modified sequence from Homo sapiens__NP_005518.3 __HsHSPA1L (opt5)
gggagagucccgcagucggcguccagcggcucugcuuguucgugugugugucguugcaggccuuauucaagcuuaccauggccaccgcuaagggcaucgccauugggaucgaccugggaacaacguacagcugcgugggcgucuuccagcacgggaagguugagauuaucgcgaacgaucaaggaaauagaaccacacccuccuauguggcuuuuaccgacacagaacggcucauuggcgaugccgccaagaaccagguggcuaugaauccucagaacaccgucuucgacgccaaacgccugaucgggagaaaguuuaaugauccggugguucaggcugacaugaaacuuuggcccuuccaagugaucaacgagggaggcaagccuaagguccuggugucuuacaaaggcgaaaauaaggccuuuuaucccgaggaaauuagcuccaugguucucacaaaacugaaggagaccgcggaggccuuccuugggcauccugugacgaacgcugucaucaccgugcccgccuacuuuaaugauucucagcggcaggcuacaaaagacgccggagugauugcgggccugaacguccuccgcaucauuaaugaaccuaccgccgcugccaucgcuuaugggcuggauaagggaggccagggggagagacacguucugauuuucgaccucggaggcggcacauuugaugugagcauccugaccaucgacgaugggauuuucgaagugaaggccacggccggagacacacaucuuggcggggaggacuuugauaaccggcuggucucccacuucguggaggaauuuaaacgcaagcauaaaaaggacaucucucaaaauaaaagagcuguucggcgccucagaaccgcgugugagcgggccaagcgcacacugagcuccagcacccaggcuaaccuugaaauugauucucuguacgagggaaucgacuucuauaccuccauuacaagagcccgguucgaggaacucugcgccgaucuguuucgcggcacgcuggagccgguggaaaaagcucucagagacgccaagauggauaaggcgaaaauccacgacaucguccugguugggggaagcacccggauucccaaggugcagagacuucugcaggauuacuucaauggccgcgaccucaacaaaucuaucaacccugaugaggcuguggccuacggcgccgcuguccaagccgcuauucugaugggggacaaguccgaaaaagugcaggaccuucugcuccuggaugucgcgccccugagccucggacuggagacagccggcggggugaugaccgcccuuaucaagcggaauagcacaauuccuaccaagcagacgcaaaucuuuacaaccuauuccgacaaccagcccggaguucugauccagguguacgaaggcgagagagcuaugaccaaagauaauaaccuccuggggcgcuucgaccuuacaggcauuccgccugcuccccggggagucccucagaucgaggugaccuuugauauugacgccaauggcauccugaacguuacagccacggauaagagcaccgggaaagugaauaagauuacaaucaccaacgacaaaggaagacucuccaaggaagagauugaacgcaugguccuggaugcggagaaguauaaagccgaagacgaggugcaacgggagaagaucgcugccaaaaaugcucuggaaucuuacgccuucaacaugaagucugugguuuccgaugagggccucaaagggaagaucagcgaaucugacaagaauaaaauucuggauaaguguaacgagcuucuguccuggcucgaggucaaucagcuggccgaaaaagacgaguuugaccacaagagaaaagaacuggagcagaugugcaaccccaucauuacaaaacuuuaucagggaggcuguaccgggcccgcuugcggcacgggauacgugccuggccgcccggcgaccgggcccacaaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4319 - RNA, 2267 nt, Artificial Sequence
  mRNA product Design3 comprising derived and/or modified sequence from Homo sapiens__NP_068814.2 __HsHSPA2 (opt5)
gggagagucccgcagucggcguccagcggcucugcuuguucgugugugugucguugcaggccuuauucaagcuuaccaugagcgccagaggccccgcuaucgggauugaccugggaaccacauacuccugcgugggcgucuuccagcacgggaagguugagaucauugccaacgaucaaggaaaucggacgaccccuucuuauguggcguuuacagacaccgaacgccucaucggcgaugcugccaaaaaccagguggccaugaauccgacaaacaccauuuucgacgcuaagagacugaucgggcggaaauuugaggaugccacaguccagagcgacaugaagcauuggcccuuccgcgugguuuccgaaggaggcaaaccuaaggugcaggucgaguacaagggcgaaaccaaaacguuuuuccccgaggagaucucuagcauggugcuuaccaagaugaaagaaauugcugaggccuaucugggaggaaagguucacuccgcggugaucacagucccugccuacuuuaaugauucucaaagacaggcuaccaaagacgccggcacaauuaccgggcucaacgugcugcggaucauuaaugaacccacggcugccgcgaucgccuauggacuugauaagaagggcugugcugggggagagaaaaacgugcugauuuucgaccucggcggcgggacauuugaugucagcauccugaccaucgaggacggaauuuucgaaguuaaguccacagccggcgauacccaucuugggggagaggacuuugacaaucgcauggugagccaccucgcugaagaguucaaaagaaagcauaaaaaggauaucggcccuaacaaacgggccgugcgcagacugcggaccgccugcgaacgcgcuaagagaacacuuucuuccagcacgcaggcgucuauugagaucgacucccuguacgagggggucgauuuuuauaccagcauuacacgggcccgcuucgaggaacucaaugcugaccuguucagaggaacccuugaaccgguggagaaggcccugcgggaugccaaacucgacaagggccagauccaagaaaucguucuggugggcgggucuacacgcauucccaaaauccagaagcugcuccaggacuuuuucaacggaaaagagcugaauaaguccauuaacccugaugaggcugucgccuacggcgcggcugugcaggccgccauccuuauuggggauaagagcgaaaauguucaagaccugcuccugcuugaugugacgccccugucccucggaaucgagaccgcuggcggggucaugacaccucugaucaaaagaaacaccaccauucccacaaagcagacccagacauuuacgaccuacucugacaaccaaagcuccgugcugguccagguguaugaaggcgagcgggccaugacaaaagacaauaaccuccugggaaaguucgaucuuaccggcaucccgccugcucccagagggguuccucagauugaagugacauuugacaucgaugccaaugggauucugaacgucaccgcggccgacaaaagcacgggcaaggagaauaagaucaccauuacaaacgauaaagggcgccucucuaaggacgauaucgaccggauggugcaggaggcugaaagauacaaauccgaggaugaagccaaucgcgaccggguugcugccaagaacgcgcuggagagcuauaccuacaauaucaaacaaacaguggaggaugaaaagcugagaggaaagauuucugagcaggacaaaaacaagauccuggauaaaugucaggaagucauuaauuggcucgaccgcaaccagauggccgagaaggacgaauaugagcacaaacaaaaggagcuggaacgggugugcaaucccaucauuagcaaacuguaccagggcgggcccggcggaggcuccgggggaggcgggucuggagcuagcggcgggccuaccaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4320 - RNA, 2870 nt, Artificial Sequence
  mRNA product Design3 comprising derived and/or modified sequence from Homo sapiens__NP_002145.3 __HsHSPA4 (opt5)
gggagagucccgcagucggcguccagcggcucugcuuguucgugugugugucguugcaggccuuauucaagcuuaccaugagcguggucggcaucgaccugggguuccaguccugcuacguugccguggcuagagccggaggcauugagaccaucgcgaacgaauauucugaucgguguacacccgcuugcauuagcuuugggccuaagaaucgcuccaucggagccgccgcuaaaucucaagugauuagcaacgccaagaauacgguccagggcuucaaaagauuucacgggcgggcuuucuccgacccguuuguggaggccgaaaagucuaaccucgcguacgauaucguucagcugcccaccggacuuacaggcaucaaagugaccuauauggaggaagaacgcaauuucacaaccgagcaggucacagccaugcugcucagcaagcugaaggaaaccgcugaguccgugcuuaaaaagccuguuguggacugugucgugagcgugcccugcuuuuacacggaugccgaaagacggucugucauggacgcuacccaaauugccggccugaacugucuccgccugaugaaugagacaaccgcgguugcccuggcuuaugggaucuacaaacaggaucucccugcccuggaggaaaagcccagaaacgugguguucgucgacaugggacauuccgcuuaucaggugagcguuugcgccuuuaaucggggcaaacuuaaggugcuggccacagcuuucgauaccacgcucgggggacgcaaguuugacgagguccuggugaaccacuucugugaagaguuuggcaaaaaguacaaacuugauauuaagucuaaaaucagagcgcugcuccggcugucccaggaaugcgagaagcugaaaaagcucaugagcgccaaugcuucugaccugccucuuuccauugaguguuucaugaacgauguugacgugagcgggacaaugaaucgcggaaaguuccuggaaaugugcaacgaccuccuggccagagucgagccgccccuucgguccgugcuggaacaaaccaaacucaagaaagaggauaucuacgccgucgaaauugugggcggcgcuacacgcaucccugccguuaaggagaaaaucucuaaguuuuucgggaaggagcugagcaccacccugaaugcggacgaagcugugacaagaggaugugcccuccagugcgccauucugucccccgcuuuuaaaguccgggaguucagcaucacggaugugguuccuuaucccauuucucuuagauggaacuccccggccgaagagggcagcucugacugcgaaguguuuagcaagaaccaugcugccccuuucuccaaaguccugaccuuuuaccgcaaggagcccuucacacucgaggcguauuacucuagcccucaggaucugcccuaucccgacccugccaucgcucaguuuuccgugcaaaaagugaccccgcagagcgaugggucuuccagcaagguuaaggucaaagugcgggugaauguccacggaauuuucucuguguccagcgccucccuuguugaagugcauaagucugaggaaaacgaggagcccauggaaacagaccagaaugcuaaagaggaagagaagaugcaagucgaucaggaggagccucacguggaggaacagcagcaacagacccccgccgagaacaaagcggaaagcgaggaaauggagacgucccaggccggcucuaaggacaagaaaauggaucagccuccccaagcuaagaaagccaagguuaaaacaagcaccguggaccugccgaucgagaaucagcuccuguggcagaucgacagagaaaugcugaaccucuacauugagaaugaagggaagaugaucaugcaggauaaacuggagaaggaacgcaacgacgcuaagaaugccgucgaggaguauguguacgaaaugcgggauaaacuuuccggagaguacgaaaaguuuguuagcgaggacgauagaaacucuuucacccugaaacucgaggacacagaaaauuggcuguaugaggauggcgaagaccaaccuaaacagguguacgucgauaagcuggccgagcuuaagaaccucggccagcccauuaagauccgcuuucaggaauccgaggagcggccuaaacuguucgaggaacuggggaagcaaauucagcaguauaugaaaaucaucagcucuuucaagaauaaagaagaccaauacgaucaccucgacgcugcggauaugaccaagguggagaaguccacaaacgaagccauggaguggaugaauaacaaacugaaccuucagaauaagcagagccugacgauggaccccguggucaaaucuaaggagauugaagcuaaaaucaaggagcucaccagcacauguuccccuauuaucagcaagcccaaaccgaagguugaaccucccaaagaggaacagaagaacgccgagcaaaauggacccguggacggccagggggauaacccuggaccgcaggccgcugagcagggcaccgacacagccgugcccucugauuccgacaaaaagcugccugaaauggauauugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4321 - RNA, 2867 nt, Artificial Sequence
  mRNA product Design3 comprising derived and/or modified sequence from Homo sapiens__NP_055093.2 __HsHSPA4L (opt5)
gggagagucccgcagucggcguccagcggcucugcuuguucgugugugugucguugcaggccuuauucaagcuuaccaugagcguggucggcaucgaccugggguuccucaacugcuacauugccguugcuagauccggaggcaucgagaccauugccaaugaauauucugaucgguguacacccgcgugcaucagccuggggucccgcacgagagcuauuggaaacgccgccaagucucagaucgugaccaaugugcggaacacaauccacggcuuuaaaaagcugcaugggcgcagcuucgacgauccuauuguccaaaccgagagaauccggcuuccguacgaacuccagaaaaugcccaauggauccgcuggcgugaagguucgcuaucuggaggaagagagaccuuuugccauugaacaggugacaggcaugcuucuggcuaaacucaaggagaccucugagaacgcccugaagaaacccgucgcggacugugugaucagcauuccuuccuucuuuacagaugccgaacggcgcagcguuauggcugccgcucagguggccgggcugaauugccucagacugaugaacgagaccacggcggucgcccuugcuuacggaaucuauaagcaagaccugcccccucucgaugagaaaccgcggaaugugguguucauugacaugggccacucugccuaccagguccugguuugugcuuuuaacaaggggaaacuuaaggugcuggccaccacauucgaucccuaucucggaggccgcaauuuugacgaagcccugguggauuacuucugcgacgaguuuaagaccaaauacaagaucaacgucaaagaaaauuccagagcucugcuccggcuguaucaggagugugaaaaacuuaagaagcugaugagcgcgaacgccucugaucucccucugaauaucgagugcuucaugaacgaccuugacguguccagcaaaaugaaccgcgcucaguuugagcaacugugugccucucuccuggccagaguugaacccccucugaaggcugugauggagcaggccaaucuccagcgggaagauauuuccagcaucgagauugucgggggagcgacaagaauccccgcugugaaggaacagauuaccaaauucuuccugaaggacaucuccacgacacuuaacgccgaugaggccguugcucgcggcugcgcccugcaaugugcuauccucucuccggccuuuaaagugcgggaguucagcauuaccgaccuggucccuuacuccaucacacuuagauggaagaccagcuuugaagauggcucuggggagugcgaaguguucugcaaaaaucaucccgcgccuuuuuccaaggucauuaccuuccacaagaaagagcccuuugaacuggaggccuucuauacaaaccuccaugaggugcccuacccugacgcucgcaucggcagcuuuacgauucagaauguuuucccgcagucugauggagacagcuccaaggugaaagucaaggugcggguuaacauccacgggaucuuuucuguggccagcgcuuccgucauugaaaaacaaaaucuggagggagaucacagcgacgcccccauggaaaccgagacaucuuucaagaacgagaauaaggauaacauggacaaaaugcaaguggaccaggaagagggccaucagaagugucacgcggaacauaccccugaggaagagaucgaucacacaggggccaaaaccaaguccgcugugagcgacaaacaggauagacugaaucagacgcucaagaagggaaaaguuaagucuauugaccugcccauccaguccagccuuugccgccagcugggccaagaucuccugaacuccuauauugagaaugaaggcaaaaugaucaugcaggacaagcuggagaaagaacggaacgaugccaagaaugcugucgaggaauacguguaugacuuuagagaucgccuugggacaguguacgagaaauucauuaccccugaggaccucucuaagcugagcgccguccuggaagauaccgagaacuggcucuacgaagacggagaggaucagcccaaacagguguauguugacaagcugcaagaacuuaagaaauacggccagccgauccagaugaaguauauggagcacgaggaacggccuaaagcccugaacgaccucgggaagaagauccagcuggugaugaaagucauugaggcuuacagaaauaaggaugaacgcuaugaccaucuggaucccacagagauggagaaaguggaaaaguguaucuccgacgcgaugucuuggcuuaacagcaaaaugaaugcccaaaacaagcucucccugacccaggauccuguugugaaggucagcgagauuguggcuaaaucuaaggaacuggacaauuucugcaaccccaucauuuacaaaccuaagcccaaagccgagguuccggaagauaagccuaaggccaauuccgagcacaacggacccauggacggccagagcgggacagagacgaaaucugauuccaccaaggacagcucucaacauacaaaaagcuccggcgaaauggagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4322 - RNA, 2312 nt, Artificial Sequence
  mRNA product Design3 comprising derived and/or modified sequence from Homo sapiens__NP_005338.1__HsHSPA5 (opt5)
gggagagucccgcagucggcguccagcggcucugcuuguucgugugugugucguugcaggccuuauucaagcuuaccaugaagcugagccucguggccgcuaugcugcuucugcucuccgccgcgagagcugaggaagaggacaaaaaggaagaugucggcaccguuguggggaucgaccugggaacaacguacucuugcgugggcgucuucaaaaacgggcggguggagauuaucgccaaugaucagggaaaccgcauuacccccagcuauguugccuuuacaccugaaggcgagagacuuaucggggacgcugccaagaaucaacugaccuccaacccggagaauacaguguucgaugcuaaacggcucauuggacgcaccuggaacgaccccucuguccagcaggauaucaaguuucugccuuucaaggugguugaaaagaagacaaaacccuacauccagguggacauuggcggcgggcaaaccaagacguuugccccugaggaaaucagcgcgaugguccugaccaaaaugaaggagacagccgaggcuuaucucggaaagaaagugacccacgccguggucacaguucccgcuuacuucaaugaugcccagagacaggcgaccaaggacgccggcacgauugcugggcugaacgugaugcggaucauuaaugaaccuacagccgcugccaucgccuauggacuugauaaacgcgagggcgaaaagaacauucugguguuugaccucgggggaggcaccuucgaugucucccugcuuacaaucgacaauggcguguuugagguuguggcuaccaacggggacacccaucugggaggcgaagauuucgaccagagagucauggagcacuuuaucaaacucuacaagaaaaagacagggaaggaugugcggaaagacaaucgcgcgguucaaaagcugagacgggagguggaaaaagccaagcgcgcucugucuagccagcaucaggccagaauugagaucgaauccuucuaugagggagaagauuuuagcgagacgcucacccgggccaaauucgaggaacugaacauggaccuuuuccgcucuacaaugaagccgguccagaaggugcuggaggauuccgaccucaaaaagagcgauauugacgaaaucguccuggugggcgggucuacccggauucccaaaauccaacagcuuguuaaggaguuuuucaauggaaaagaaccuuccagaggcaucaaccccgaugaggcuguggccuacggcgcggcuguccaggccggggugcugagcggagaccaagacacaggcgaucucguucugcuggacguguguccucucacccuggggauugagacggucggaggcgugaugacaaaacuuauccccagaaacaccgugguuccgaccaagaaaucucagaucuuuuccacagccagcgauaaucagccuaccgucacaauuaagguguacgaaggggagcgcccccugacgaaagacaaccaccuccugggcaccuucgaucuuacaggcauuccucccgcuccccggggagugccucagaucgaagucaccuuugagaucgacgugaaugggauucugagaguuacagccgaggauaagggaaccggcaacaaaaauaagaucacgauuaccaacgaccaaaaucgccucacaccggaagagaucgaacggauggugaacgaugcugagaaguucgccgaagaggacaaaaagcugaaagagagaauugauacccgcaaugaacuggaguccuaugcguacucucucaagaaccagaucggggacaaagaaaagcugggaggcaaacuuagcuccgaggauaaggaaacaauggagaaggccgucgaggagaaaauugaauggcuggaaagccaucaggacgcugacaucgaggauuuuaaggccaaaaagaaagaacucgaggagaucgugcagcccauuaucucuaagcuguauggguccgcuggcccucccccuaccggagaagaggacacggccgaaaaggaugagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4323 - RNA, 2279 nt, Artificial Sequence
  mRNA product Design3 comprising derived and/or modified sequence from Homo sapiens__NP_002146.2__HsHSPA6 (opt5)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuucagaguggucuccgaagggggaaagccuaaagugcggguuuguuaccgcggcgaggauaagaccuuuuaucccgaagagauuucuagcauggugcuguccaagaugaaagagacggccgaagcguaccuuggccagccugucaagcacgccgugaucaccgugcccgcuuauuucaacgacucucagagacaggccacaaaagaugcuggggccauugcgggacugaauguccuccggaucaucaacgagccuaccgccgcugccauugcuuacggccuggaccgcagaggggccggagaacggaauguucugaucuuugaucucggcgggggaacauucgacgugagcgugcuguccauugaugccggcgucuuugaggugaaggcuaccgcgggcgacacgcaucuugggggagaggacuucgauaaccgccugguuaaucacuuuauggaagaguucagacggaaacauggcaaggaccucagcgggaacaagcgcgcccugagacggcuuagaacagcuugcgaacgcgccaaacggacccugucuuccagcacacaagccacccucgagaucgauucucuguuugaaggaguggacuucuauaccuccauuacaagagcucgcuucgaggagcuguguagcgaucucuuucggucuacgcuggaaccggucgagaaggcccuuagagacgcgaaacuggauaaggcucagauccacgacgugguucucgugggcggguccacccgcauucccaaaguccagaagcugcuucaggauuucuuuaauggaaaagaacugaacaagagcaucaauccugacgaggccguggccuacggcgcugccguccaagcugccgugcucaugggcgauaagugcgaaaaaguucaggaccugcugcuccuggacguggcgccccuuucccuggggcucgagacagccggaggcgucaugaccacacugauccagcggaacgcuaccauuccuacgaagcaaacacagaccuucaccacauacucugauaaucagcccgggguguuuauccagguuuaugagggagaaagagccaugaccaaagacaacaaccuucugggccgcuucgagcucagcgggauuccgccugcuccccggggcgugccucaaaucgaagucacauuugauauugacgccaauggaauccuguccgugacggcgaccgauagaagcacaggcaaggccaacaaaaucaccauuacaaaugacaaggggcgccugucuaaggaggaaguggagcggaugguucacgaggcugaacaguacaaagccgaggaugaagcucagagagaccgggucgccgccaagaacucccucgaggcucauguguuccacgugaaaggaagccugcaggaggaaucucuucgcgauaagauccccgaggaagacagacggaaaaugcaagauaaguguagagagguccuggcguggcucgaacauaaucagcuggccgagaaggaggaauaugagcaccagaaacgcgaacuggagcagauuugccggcccaucuuuagcagacuuuacggcgggccuggagugccgggcggguccucuuguggcacccaagcucgccagggagaccccagcacgggcccuauuaucgaagagguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4324 - RNA, 1451 nt, Artificial Sequence
  mRNA product Design3 comprising derived and/or modified sequence from Homo sapiens__P48741__HsHSPA7 (opt5)
gggagagucccgcagucggcguccagcggcucugcuuguucgugugugugucguugcaggccuuauucaagcuuaccaugcaggcccccagagagcuggcugugggcaucgaccucgggaccacauacagcugcgucggaguuuuccaacagggccggguggaaauucuggccaacgaucaggggaaucgcacgaccccuuccuauguggcguuuacagacaccgagagacuugucggagaugcugccaagucucaggccgcucugaacccgcacaauacaguguucgacgccaaacggcucaucggccgcaaguuugcugauaccacaguucaaagcgacaugaaacauuggcccuuccagguggucuccgaagggggaaagccuaaagugagaguuuguuaccggggcgaggauaagaccuuuuaucccgaagagauuucuagcauggugcuguccaagaugaaagagacggccgaagcguaccuuggccagccugucaagcacgccgugaucaccgugcccacauauuucucuaacagccagcgccaagcuaccaaagacgccggggcuauugccggacugaagguccucccuaucaucaaugaggcgacagccgcugccauugcuuacggccuggauagacgcggggccggaaaacggaacguucugaucuuugaccucggcgggggaaccuucgauguguccgugcugagcauugacgccggcgucuuugaagugaaggcuacggcgggcgauacacaucuugggggagaggacuucgacaauagacugguuaaccacuuuauggaggaguuccggcgcaagcauggcaaagaucucucugggaauaagagagcccugcggcgccuuagaaccgcuugcgagcgggccaaaagaacaccguccagcucuacccaggccacccuggaaaucgacucccucuuugagggaguggauuucuauaagagcauuacacgcgcucgguucgaagaacuguguucugaccuguuuagauccacgcucgagcccgucgaaaaagcccugcgcgaugcgaaacuugacaaggcucagauccacgauuucgugcugggcgggggacuccacagccauccucagggcgccgagguugccgcuggccugcuucaacggcagggggccgaacaggagcaccaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4325 - RNA, 2288 nt, Artificial Sequence
  mRNA product Design3 comprising derived and/or modified sequence from Homo sapiens__NP_006588.1 __HsHSPA8 (opt5)
gggagagucccgcagucggcguccagcggcucugcuuguucgugugugugucguugcaggccuuauucaagcuuaccaugagcaagggccccgccguggggaucgaccugggaaccacauacuccugcgucggcguuuuccagcacgggaaaguggagauuaucgcuaacgaucaaggaaauagaacgaccccuucuuauguggccuuuacagacaccgaacggcucauuggcgaugcggcuaagaaccaggucgccaugaauccgacaaacaccguguucgacgccaaacgccugaucgggagacgguuugaugacgcuguugugcagagcgauaugaagcauuggcccuucauggucgugaaugacgccggacgcccuaaaguucagguggaguacaagggcgaaacaaaguccuuuuaucccgaggaagucucuagcauggugcuuaccaaaaugaaggagauugcugaggccuaccugggcaaaacggugaccaacgcggucguuacagugccugccuauuucaaugauucccaaagacaggcuaccaaggacgccgggacaaucgcuggacucaacgugcugcggaucauuaaugaacccaccgccgcggccaucgcuuacggccuugauaaaaaggucggggccgagcgcaacgugcugauuuuugaccucggaggcgggacguucgauguuucuauccugacaauugaagacggaaucuuugaggugaagucuaccgcuggcgacacacaccugggcggggaggauuucgacaauagaauggucaaccauuuuauugccgaauuuaaacggaagcacaaaaaggauaucuccgagaauaaacgcgccgugagacggcuccgcaccgcuugugaaagagcgaagcggacccugagcagcuccacacaggccagcaucgagauugacucucuuuaugaaggaaucgauuuuuacacguccauuacccgcgcuagauucgaggagcugaacgccgaccucuuccggggcacacuggauccuguugaaaaagcccuuagagacgcuaagcuggauaagagccagauccaugacauugugcucgucgggggaucuacccgcaucccgaaaauccaaaagcugcugcaggauuucuucaauggcaaagagcucaacaaguccauuaaccccgacgaagccguggcguacggggcugccguccaggccgcuauccugagcggagacaaauccgagaaugugcaggaucuucugcuccuggacguuacaccucuuucucugggcauugaaaccgccggcggggugaugacgguccucaucaagcggaacacaaccauucccaccaagcaaacacagaccuuuacaacguauagcgauaaucagccuggagugcugauccaaguuuacgagggcgagagagcuaugaccaaagacaacaaucugcucgggaaguucgaacugacaggaaucccgcccgccccucgcggcgugccccagauugaggucaccuuugauaucgacgcgaacgggauucuuaauguguccgccguggauaaaagcacaggcaaggaaaacaaaaucaccauuacgaaugacaagggacggcugucuaaggaggauaucgaaagaaugguucaggaggcugagaaauauaaggccgaagacgagaaacagcgcgauaaggucuccagcaaaaacucucucgaaagcuacgcuuucaauaugaaggccaccguggaggacgagaagcugcaaggcaaaauuaacgaugaagacaagcagaaaauccuugacaagugcaaugagaucauuaacuggcuggauaaaaaucagacagcggaaaaggaggaauuugagcaccagcaaaaagagcucgaaaagguguguaacccuaucauuaccaagcuguaucaguccgccgggggaaugcccggcgggaugcccggaggcuucccugggggcggagcuccgcccucuggcggggccagcuccggaccuacaaucgaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4326 - RNA, 2387 nt, Artificial Sequence
  mRNA product Design3 comprising derived and/or modified sequence from Homo sapiens__NP_004125.3 __HsHSPA9 (opt5)
gggagagucccgcagucggcguccagcggcucugcuuguucgugugugugucguugcaggccuuauucaagcuuaccaugaucagcgccuccagagcugccgcggcucggcuggugggcgccgccgcuucucgcgggcccaccgccgcuagacaccaggacagcuggaacggacucucccaugaggccuuccggcuggucucucgcagagauuacgcgagcgaagccauuaagggcgcuguuguggggaucgaccuuggaacaacgaauagcugcguggccgucauggagggcaaacaagcuaaggugcuggaaaacgccgagggggcgcggaccacaccuucuguuguggccuuuaccgcugauggagaacgccucgucggcaugccggccaaaagacaggcugugacaaaucccaacaauaccuucuaugccacaaagcggcugauuggccgcagauacgacgauccugagguucagaaagacaucaagaacgugcccuuuaagauuguccgggccagcaauggggaugcuuggguggaggcgcacggaaaacuuuauuccccuagccagaucggcgccuucgugcugaugaagaugaaagaaaccgcugagaacuaccucgggcauacggccaagaaugccgucaucaccguucccgcuuauuuuaacgacucucaacgccaggccacaaaagaugcgggacagauuuccggccugaaugugcugagagugaucaacgaaccuaccgcugccgcccucgcuuacgggcuggacaagagcgaggauaaggucauugccguguaugaccuuggaggcggcacauucgauaucucuauucuggagauccagaaagggguuuuugaagugaaguccaccaauggagacacguuccucggcggggaggacuuugaucaagcucugcuucggcacauugucaaagaguucaagcgcgaaacaggaguggaccugaccaaagauaacauggcccuccagagaguucgggaagcggccgagaaggcuaaaugugagcuguccucuuccgugcagacagacaucaaucugccguaccucaccauggauagcuccggccccaagcaucugaacaugaaacuuaccagagcccaguuugaagggaucgucacagaccugauucgccggacgaucgcuccuugccaaaaggccaugcaggaugcggaggugucuaagagcgacauuggagaagucauccucgugggcggcaugaccagaaugcccaaaguucagcaaacagugcaggaucuguucgggcgcgccccuuccaaggcugucaaccccgacgaggccguggcuauuggagccgccauccagggcgggguucuugcuggagaugugaccgacguccugcuccuggacgugacaccgcugagccucggcaucgaaacccugggcggcguguuuacgaaacuuauuaaucggaacacaaccaucccuaccaagaagucucagguuuucuccacagcggccgauggacaaacccaggucgagauuaaagugugucagggcgagagagaaauggcuggggacaauaagcugcucggacaguucacacugaucggcauucccccugcuccccgcggggugccccaaaucgaggucacguuugauaucgacgccaacggaauugugcacguuagcgccaaagauaagggcaccgggcgggaacagcagaucgugauucagucuagcggcggacuuuccaaagacgauaucgagaauauggucaagaacgccgaaaaguacgcggaggaggacagacgcaaaaaggaacggguggaggcuguuaauauggccgaaggcauuauccacgauacagagaccaaaauggaggaguucaaggaccaacugccugccgaugaaugcaacaaacucaaggaagagauuucuaagaugagagaacugcuggcucgcaaagacagcgagacaggggagaauauccggcaggccgcguccagccuccagcaggcuucucugaaacuuuuugaaauggccuauaagaagauggccuccgagagagaaggaagcgggucuuccgggaccggagagcaaaaagaagaucagaaggaggagaaacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4327 - RNA, 2375 nt, Artificial Sequence
  mRNA product Design3 comprising derived and/or modified sequence from Homo sapiens__NP_079291.2__HsHSPA12A (opt5)
gggagagucccgcagucggcguccagcggcucugcuuguucgugugugugucguugcaggccuuauucaagcuuaccauggccgacaaggaggcuggcgggagcgauggacccagagaaaccgccccuacauccgcguacucuagcccggcucggucccugggcgacacggggaucacaccccucucuccuagccacauugugaacgauaccgacuccaaugucucugagcagcagagcuuccugguugugguggccgucgauuuuggaaccacauccagcggcuaugccuacucuuucaccaaagaacccgagugcauccaugugaugcgcagaugggaagggggagacccuggcguuuccaaccaaaagacacccaccacgauucuucugaccccugagcggaaauuucacagcuucggcuaugcugcccgcgauuuuuaccaugaccucgauccgaaugaggcuaagcaguggcuguaucuugaaaaauucaagaugaagcugcacacaaccggggaccucacaauggauaccgaccugacggccgcgaacggcaaaaaggugaaagcccuggagaucuuugcuuacgcccuccaguauuucaaggaacaagcucugaaagagcuuucugaucaggccggauccgaguuugaaaauagcgacgucagaugggugauuacaguucccgcgaucuggaagcagccugccaagcaguucaugcggcaagcugccuaccaggcugggcuggccucucccgagaacuccgaacagcucaucauugcccuggagccugaagcugcgagcaucuacugucgcaaacuuagacugcaucagaugauugagcucuccucuaaggccgcugugaauggauauagcggcuccgacaccgucggggccggauuuacacaagccaaagagcacauccggcgcaacagacagagccggaccuuccugguggaaaaugugauuggcgagaucuggucugaacuggaggaaggcgauaaguacgucguuguggacuccgggggaggcaccguggaucucacaguccaccagauucgccugcccgaggggcaucuuaaagagcuguauaaggcuacgggaggcccguacgggagccucggaguggacuaugaauuugagaaacugcuuuacaagaucuucggcgaagauuucaucgagcaauuuaagauuaaaagaccugccgcguggguugaccugaugaucgcuuucgaaucucggaagcgcgccgccgcucccgauagaaccaacccucucaauauuacacugcccuuuagcuucaucgacuauuacaaaaaguuucggggccacuccguggagcaugcccugagaaaaucuaacgucgauuucgugaaguggagcucccaggggaugcuccgcaugagccccgacgcuaugaaugcccuguuuaagccuaccauugauucuaucaucgagcaccuucgggaccuguuccagaaaccggaaguuuccacagugaaguuucucuuccuggucggaggcuuugcggaggcuccccuucugcagcaagccgugcaggccgcuuucggggaccagugcagaauuaucauuccucaggaugucggacucaccauccugaaaggcgccgugcuguuugggcucgaccccgcgguuauuaaggugcgccggagcccucugacguacggcgucggagugcuuaacagauauguugaaggcaaacaucccccggagaagcugcucgugaaggaugggacacgcugguguaccgacgucuucgauaaauucaucucugccgaccaauccguggcucugggagagcuggugaagcggagcuacaccccugccaaacccucccagcuuguuaucgucauuaauaucuauucuagcgaacacgauaacguguccuuuauuacagacccuggcgugaagaaaugcgggacccucagacuggaucugacaggaacgucuggcaccgcuguccccgcccgccgggagauccagacacucaugcaguucggggacaccgaaauuaaggccacagcuaucgauauugcgaccagcaaguccgugaaaguuggcaucgacuuucugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4328 - RNA, 2408 nt, Artificial Sequence
  mRNA product Design3 comprising derived and/or modified sequence from Homo sapiens__NP_443202.3 __HsHSPA12B (opt5)
gggagagucccgcagucggcguccagcggcucugcuuguucgugugugugucguugcaggccuuauucaagcuuaccaugcuggccgugcccgagaugggccuccaggggcuguacaucggaagcuccccugaaagaucuccgguccccagcccucccggcuccccucggacccaagagucuugcgggauugcuccccuuacaccuagccaguccccgaagcccgaaguucgcgccccucagcaggcgucuuucagcgugguggucgcuaucgacuuuggaacgaccuccagcggcuaugccuucucuuuugccuccgaucccgaggcuauucacaugaugagaaaaugggaagggggagacccuggcguggcccaucaaaagacacccaccugucugcuccugacaccggagggcgcuuuccacagcuuuggguacaccgcccgggauuauuaccaugaccuugauccugaggaagcgcgcgacuggcuguauuucgagaaauuuaagaugaaaauccacucugccacagaucucacccugaagacgcagcuggaagcuguuaacggaaagaccaugcccgcccucgagguguucgcucaugcccugagauuuuuccgggagcacgcgcuucaggaacugcgcgagcaguccccuagccuccccgaaaaagacacagucagaugggugcugaccguucccgccauuuggaagcaaccugcuaaacaguuuaugcgggaggccgcuuaccuugccggccuggugucucgcgaaaaugccgagcagcuccugaucgcucuggagccggaagcggccuccgucuauugcagaaagcuccggcugcaccagcuucuggaucucagcgggcgcgcucccggaggcgggagacugggagagcggcgcuccaucgacucuagcuucagacaagcccgggaacagcuuagacgcucccggcauagcagaacauuucugguggagucuggcgugggcgaacucugggccgagaugcaggcuggggaucgcuacgucguugccgacuguggaggcgggaccguggaucugacggugcaccaacuggagcagccucauggaacacucaaagaacuguacaaggcguccggcgggcccuauggagcugucggcguggaccuugccuucgagcagcugcucugccggauuuucggcgaagacuuuaucgccaccuucaagagacagcgcccugcugccuggguugaucugacaauugcuuuugaggcccggaaaagaaccgcggggccccaccgcgccggagcucuuaacaucagccugccguucucuuuuauugacuucuaccggaagcaaagaggccacaauguggaaaccgcccuccgccggagcuccgucaacuuugugaaauggucuagccaggggaugcugagaauguccugugaggcuaugaaugagcuguuccagccuacaguuagcggaaucauucagcauaucgaagcccuccuggcgcggcccgaggugcaaggcgucaaacuucuguuucucgucgggggcuucgccgaaucugcugugcugcagcacgccgugcaggcugcccugggagcccgcggccuuagaguuguggucccucaugauguggggcucacgauccugaagggagcuguucuguuuggccaggcgcccggggugguccgggugagacgcuccccucucaccuauggagugggcguucugaaccgguucguccccgggagacacccgccugagaaacuucuggugcgcgacggcagacgguggugcacagauguguuugagcgcuucgucgccgcugaacaaagcguggcccucggagaggaaguuagacggucuuacugucccgcccgccccggccagagacgggugcugauuaaucuguauugcugugcugccgaggacgcgcgcuucaucaccgauccuggggucagaaagugcggagcucuuucccucgaacuggagccggccgacuguggccaggauacagccggggcucccccuggacggcgcgagauuagagccgcgaugcaguuuggcgacaccgaaaucaaggugacggcuguugaugugagcacaaaccgguccgucagagccucuauugacuuccugagcaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4329 - RNA, 1763 nt, Artificial Sequence
  mRNA product Design3 comprising derived and/or modified sequence from Homo sapiens__NP_008879.3__HsHSPA13 (opt5)
gggagagucccgcagucggcguccagcggcucugcuuguucgugugugugucguugcaggccuuauucaagcuuaccauggccagagagaugaccauccugggcagcgcugugcucacacugcuucuggccggguaccucgcgcagcaauaucugccccuuccuacgccgaaggucauuggaaucgaccugggcaccacauacugcuccguugggguguucuuucccggaaccggcaaagugaaggucauuccugaugaaaacgggcacaucucuauucccagcaugguguccuucacagacaaugauguuuaugugggauacgagucugucgaacucgcugacagcaacccucagaauaccaucuaugaugccaaacgguuuaucggcaagauuuucacagccgaggaacuggaggcugagaucggccgcuaccccuuuaaagugcugaacaagaaugggaugguugaguucuccgugaccucuaacgaaacgauuaccgucagcccugaauaugugggauccagacuccugcuuaagcugaaagagauggccgaggcuuaccucggcaugccgguggccaaugcggucaucagcguucccgccgaauuugaccugaagcagcggaacucuacaauugaggcugccaaucuugcugggcugaaaauccuccgcgugauuaacgaaccuaccgccgcggccauggcuuacggacugcauaaggccgauguguuccacguccuggugaucgaccucggcgggggaacacuggauguuucccuucugaauaaacagggcggcauguuucucaccagagcuaugagcgggaacaauaagcugggaggccaagacuucaaccagcggcuucugcaguaucucuacaagcagaucuaucaaacguacggguuugugcccucucgcaaagaggaaauucauagacugcggcaggccgucgagauggugaagcugaaucucacacugcaccaguccgcccagcuuagcguucugcucaccguggaggaacaagaucgcaaagagccucauucuuccgacacagaacugcccaaggauaaacuuagcuccgcugacgaccacagagucaacucuggauucggccgggggcugagcgauaagaaauccggagagagccaggugcucuuugaaaccgagaucucucgcaagcuguucgacacccugaacgaggaucucuuccagaagauucuggucccgauccaacaggugcuuaaagaaggccaccuggagaagacagaaauugacgagguugugcucgucggcggguccacgagaaucccucggauccgccaggugauucaggaauuuuucggaaaagaucccaauaccagcguugacccugaucuggcgguggucacaggcguggccauccaagcugggauugacggaggcucuuggccccuucaggugagcgcccuggagauccccaacaagcaucuccagaaaaccaauuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4330 - RNA, 1877 nt, Artificial Sequence
  mRNA product Design3 comprising derived and/or modified sequence from Homo sapiens__NP_057383.2__HsHSPA14 (opt5)
gggagagucccgcagucggcguccagcggcucugcuuguucgugugugugucguugcaggccuuauucaagcuuaccauggccgcuaucggcguccaccuggggugcaccagcgccugugucgcgguuuacaaggacggcagagcuggagugguggccaacgaugccggggaccgggucacacccgcugugguugccuauuccgagaaugaagagauugugggacucgcugccaaacagucucgcaucagaaacauuagcaauacggucaugaaggugaaacaaauccugggccgguccucuagcgauccucaggcgcagaaguacauugccgaauccaaaugccuuguuaucgagaagaacgggaagcugcgcuaugaaaucgacaccggagaggagacaaaauucgugaauccggaagaugucgcuagacucaucuuuucuaagaugaaagagaccgcccauagcgugcugggcuccgacgcuaacgauguggucauuacaguucccuucgacuuuggcgaaaagcagaaaaaugcccuuggggaggcggcccgggcugccggauucaacgugcugcgccucauucacgagccuagcgcugcccugcuggccuacggcaucgggcaagauucucccaccggaaaguccaauauucucguguuuaagcugggcgggacaagccuuucucuguccgucauggaagugaacagcggaaucuauagaguucucucuaccaauacggacgauaacauuggcggcgcucauuucaccgagacacuggcgcaguaccuugccuccgaauuucagcggagcuucaaacacgacgugcgcgggaaugcuagagccaugaugaagcugaccaacuccgccgaggucgcuaaacauucucucagcacacugggauccgccaauuguuuucuggauagccucuaugaaggccaggacuucgacugcaacgugucucgggcgcgcuuugagcugcuuuguuccccucuguucaacaagugcaucgaggcuaucagagggcuccuggaucaaaauggauuuaccgccgacgauauuaacaaaguugugcuuuguggcgggagcucucggauccccaagcugcagcagcucauuaaagaccuguucccugccgucgaacugcucaauagcaucccgcccgaugaggugauuccuaucggagcugccaucgaagcuggcauucugaucggcaaggagaaccuucuggucgaagacucccucaugauugagugcucugcccgcgauauccuggugaaggggguugacgagagcggagcguccagauucacggugcuuuuucccagcggcacaccucugcccgcccggagacagcacacccuccaagcuccggggucuauuuccagcgucugucuggaacuguacgagucugauggcaaaaauuccgccaaggaagagacaaaauucgcucaggugguucuccaggaccuggauaagaaagaaaacggacuucgcgacauccuggccgugcucaccaugaagcgggacgggagccugcacgugaccugcacagaucaagagacgggcaagugugaggcgaucuccauugaaaucgccucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4331 - RNA, 2924 nt, Artificial Sequence
  mRNA product Design3 comprising derived and/or modified sequence from Homo sapiens__NP_006635.2 __HsHSPH1 (opt5)
gggagagucccgcagucggcguccagcggcucugcuuguucgugugugugucguugcaggccuuauucaagcuuaccaugagcguggucggccuggacguugggucccagucuugcuacaucgccguggcuagagccggaggcauugagaccaucgcgaacgaauuuagcgaucgguguacacccuccgugauuucuuuugggagcaagaaucgcacgaucggagucgcugccaaaaaccaacagauuacccacgccaauaacacaguguccaauuucaagagauuucauggccgggcuuucaacgacccuuuuauccagaaagagaaggaaaaucucucuuaugaucugguuccgcuuaaaaacgggggagugggcaucaaggucauguacaugggcgaggaacaccuguucagcguggagcagauuaccgccaugcuccugacaaaacuuaaagagaccgcugaaaauucccugaagaaacccguuacagacugcgugaucagcgucccuucuuucuucaccgaugccgagcgcagauccgugcucgacgcggcccaaauuguggggcugaacugucugcggcucaugaaugauaugacggcugucgcccugaacuauggaaucuacaagcaggaccuucccagccuggaugaaaaaccucgcauuguuguguuuguggacaugggccauucugcuuuccaggucuccgccugcgcguuuaauaaggggaagcucaaagugcugggaaccgccuucgaucccuuucuuggcgggaagaacuucgacgagaaacugguugagcacuucugugcugaauuuaagacaaaauauaagcucgaugccaaaagcaagaucagagcucugcugcggcucuaccaggagugcgaaaagcugaaaaagcugaugucuuccaauagcaccgaccuuccucucaacauugaguguuucaugaacgacaaagauguguccggaaagaugaaucgcucucaauuugaggaacugugcgccgagcuucugcagaaaaucgaagucccgcucuauagccugcuggagcagacacaucucaagguggaagacguuuccgccguggagaucgucggcggcgcuacccggauucccgcggugaaggaaagaaucgccaaauucuuugggaaggauauuagcacgacacugaacgcugacgaggccgucgcccgcggaugugcccuucagugcgcuauccugucuccugcguucaaagugagagaguuuuccguuaccgaugcugugcccuucccuauuagccucaucuggaaucacgacucugaagauacagagggcguccacgaaguguuuagccggaaccaugccgcccccuucuccaagguucugaccuuucuucgcagagggccguucgagcuggaggcuuuuuacucugacccucaaggagugcccuacccugaagccaaaaucggccgguucgucgugcagaaugugagcgcucagaaggauggggagaaguccagaguuaaagucaaggugcgcgugaacacccacggaauuuucacaaucagcacggccucuauggucgaaaaagugcccaccgaggaaaaugagauguccagcgaggcggacauggaaugucucaaccaacggcccccugagaauccggauacagacaagaacguucagcaggacaauucugaagccggcacccagccccaagugcagacagaugcucagcagaccucccaaagcccucccuccccugagcugacgucugaagagaacaaaauucccgacgccgauaaggcuaaugagaagaaagucgaccagccgccugaagccaagaaacccaagaucaaagugguuaacguggagcugccuauugaagcgaaucucgucuggcagcugggcaaggaucuucugaacauguauaucgagacagaagggaaaaugaucaugcaggacaagcucgagaaggagagaaacgaugccaaaaaugcuguggaagaguacguuuaugaauuucgcgacaagcugugcggacccuacgagaaauucauuugcgaacaagaucaucagaacuuucugcggcuucucaccgagaccgaggacuggcuguaugaagagggcgaagaucaggccaagcaggcuuacguggacaaacuggaggagcucaugaagaucgggacaccugucaaggugagauuccaagaagccgaggaacgccccaaaauguuugaggaacugggacagcggcuucagcacuaugccaagauugcugcggauuucagaaauaaagacgagaaguacaaccacaucgacgagagcgaaaugaaaaagguggagaaguccgucaaugaaguuauggaguggaugaacaaugugaugaacgcccaagcuaaaaagucucuggaucaggacccggugguccgcgcccaggaaauuaaaaccaagaucaaagagcucaauaacacaugugagccugugguuacgcagcccaagcccaagauugaaagcccuaaacuggagcggaccccgaauggccccaacaucgauaagaaagaagaggaccuggaagauaagaauaacuuuggggccgagccuccccaucaaaauggcgagugcuacccuaacgaaaagaacuccgugaauauggaccuugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4332 - RNA, 3347 nt, Artificial Sequence
  mRNA product Design3 comprising derived and/or modified sequence from Homo sapiens__NP_006380.1 __HsHYOU1 (opt5)
gggagagucccgcagucggcguccagcggcucugcuuguucgugugugugucguugcaggccuuauucaagcuuaccauggccgacaaggugagacggcagcgccccagacggcgcgucugcugggcucugguugccgugcuccuggcggaucuucuggcucucagcgacacccuggccgugauguccgucgaucuuggcucugagagcaugaaaguggccaucguuaagccuggggugccgauggaaaucguccugaacaaagaguccagacggaagacacccgugaucguuacgcucaaagaaaaugagcgcuucuuuggagacucugcugccagcauggcuauuaagaacccuaaggccacccugagauacuuccaacaucugcucggcaaacaggcggauaauccccacguggcccuguaucaggcucgguuuccugaacacgagcuuacauucgacccccagcgccaaaccguccauuuucagaucuccucucagcugcaguucagcccugaggaagugcucgggauggugcugaacuacuccagaagccuugccgaggauuuugcugaacaaccgauuaaggacgccgucaucacaguucccguguucuuuaaucaggcggagcggcgcgccgugcugcaggcugccagaauggcuggacucaaaguccugcagcugaucaacgauaauaccgccacagcccucucuuauggcguguuccggcgcaaggacauuaacaccacggcucaaaauaucauguuuuacgauaugggguccggaagcaccguuuguacaauugugaccuaucagauggucaaaacaaaggaggcgggcaugcagccucaacugcagaucagaggcgugggguucgaccggacccuuggaggccuggaaauggagcucagacugcgcgaacggcuugccgggcuguuuaacgagcagagaaagggacagcgcgcuaaagauguucgggaaaaucccagagccauggccaagcuccugcgcgaggcuaaccggcugaaaacggugcucucugccaaugcggaccacauggcucaaauugagggccugauggacgaugucgacuucaaggccaaagugacaagagucgaguucgaggaacuuugcgccgaucuguuugagcgcgugccugggcccguucagcaggcucuccaguccgccgaaaugagccuggacgagaucgagcaagugauucuugucggaggcgcuacccgggugccgagaguucaggaagugcugcucaaggccgucggcaaagaggaacuggggaagaacaucaaugcggaugaggccgcugccaugggagcuguguaccaggccgcggcccugucuaaggcuuucaaagugaagccuuuuguuguccgcgacgccgugguguaucccauccucgucgaguucacacgggagguggaggaagaaccuggcauucauucccugaaacacaacaagagaguucuuuuuagccggauggggcccuacccccagcgcaaagugaucaccuucaacagauacucccacgauuuuaauuuccauauuaacuauggagaccugggcuuucucgggccugaagaucugcgggucuucggaucucaaaaucugaccacagugaagcucaagggcguuggcgacagcuuuaaaaaguacccggauuaugaguccaaagggaucaaggcucacuucaaccucgacgagagcggagugcugucucuggacagagucgaauccguguuugagacgcucguugaagauagcgccgaggaagagucuacccugacaaaacuuggcaauaccauuagcucccuguucgggggaggcacaacccccgacgccaaggagaacgggacggauacagugcaggaagaggaagagucuccugcugaaggcagcaaggacgagcccggagagcaggucgaacucaaagaggaagcggaggccccuguggaagauggcucccagcccccgccucccgagccuaagggggacgcuacccccgagggagaaaaagccaccgagaaggaaaauggcgauaaaagcgaggcccaaaagccuucugagaaggcugaagccgggcccgagggaguggcgccggcuccugaaggcgagaaaaagcagaaacccgcccgcaagcggagaauggucgaagagaucgggguugagcugguggugcuggaccuucccgaucucccugaagacaaacuggcccaguccguccaaaagcugcaggaucucacacugcgcgaccuugagaaacaggaaagagagaaggcugccaacagccuggaagcguucaucuuugagacccaggauaagcucuaccaaccggaguaucaggaagugucuacagaggaacagcgggaggaaauuuccggcaaacugagcgcugccuccacguggcuggaggacgagggaguuggcgccaccacagugaugcuuaaggaaaaacucgcugagcugcgcaagcugugucaggggcuuuucuuuagagucgaagaacggaaaaaguggcccgagcgccugucugcccuugacaaucugcucaaccauagcuccauguuccugaagggagcuagacugaucccugaaauggaucaaauuuuuaccgagguggaaaugacaacccuugagaaaguuaucaaugaaacgugggccuggaagaacgcgacccucgccgagcaggcuaaacugcccgccacagagaagccugugcugcucucuaaagacauugaagcuaagaugauggcccuggaucgggagguccaguaccuucugaauaaggccaaauucaccaagccccgcccuagacccaaagacaagaacggcacacgggcugaaccgccucucaaugcgagcgccuccgaucagggggagaaagugauucccccugcuggacaaaccgaagacgccgagcccaucagcgagccggaaaagguugagacgggcucugaaccuggggauacagagccccuggaacugggcggaccuggcgccgagcccgagcagaaggaacaguccaccgggcaaaaacgcccccuuaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4333 - RNA, 2546 nt, Artificial Sequence
  mRNA product Design3 comprising derived and/or modified sequence from Homo sapiens__NP_005339.3 __HsHSP90AA1 (opt5)
gggagagucccgcagucggcguccagcggcucugcuuguucgugugugugucguugcaggccuuauucaagcuuaccaugcccgaggaaacccagacacaagaccagcccauggaggaagaggaaguggagacguucgccuuucaggcugagaucgcccagcugaugagccucauuaucaacaccuucuacuccaauaaggaaauuuuucugagagagcuuaucucuaacagcuccgaugcgcuggacaaaauucgguaugaaucucucacagauccgagcaagcuggacuccggcaaagagcuucacaucaaucugauccccaacaagcaagaucgcacccucacaauugucgacaccgggaucggaaugacaaaagcugaucugauuaauaaccugggcaccaucgccaagucugggacgaaggccuucauggaggcucuccaggccggagcugacauuagcaugaucggccaguuugggguuggauucuacuccgccuaucugguggcggaaaaagugaccgucauuacaaagcauaaugaugacgagcaguacgccugggaaagcucugcuggcggcuccuuuaccgugagaacagauaccggggagccuaugggacggggcacgaaaguuauccuucaccugaaggaagaccaaacagaguaucucgaggaacgcagaaucaaagagauugugaagaagcauagccaguucaucggguaccccauuacccuguuugucgaaaaagagcgggauaaggaagugucugacgacgaggccgaggaaaaagaggauaaggaagaggaaaaagagaaggaggaaaaagaguccgaagacaagccugagaucgaggauguuggaagcgacgaagaggaagagaagaaagauggcgacaagaaaaagaaaaagaagauuaaagaaaaguauaucgaucaggaggagcuuaacaaaacaaagcccaucuggacccgcaauccugacgauauuaccaacgaagaguacggggaguucuacaaaucucugacaaaugacugggaggaucaccucgcugugaagcauuuuuccgucgaaggacagcuggaguucagagcccugcucuuugugccgcggcgcgcgcccuucgaccuguucgagaacagaaagaaaaagaauaacaucaaacuuuaugugcggcgcgucuuuauuauggacaauugcgaagaacugaucccugaauaccucaacuucauuagaggcguuguggauagcgaggaccugccccuuaacaucucccgggaaaugcugcaacagucuaagauccucaaagugauucgcaagaaucuggucaagaaaugucuggagcucuuuacggagcuggccgaagauaaggagaacuauaaaaaguucuacgaacaguuuagcaaaaauaucaaacuuggcauucacgaggacucccaaaacagaaagaagcugagcgagcuccugcgguauuacaccucugcuuccggggaugaaauggugagccuuaaggacuauugcacaagaaugaaagagaaucagaagcacaucuacuacauuaccggagaaacaaaagaucagguugccaacucugcuuucguggagcgccugcggaagcauggccucgaagucaucuauaugauugagccuaucgacgaguacugugugcagcaacugaaagaauuugaggggaagacccugguuagcgugacgaaggaaggacucgagcugcccgaagaugaggaggagaaaaagaaacaggaagaaaagaaaacaaaguucgagaaucuuugcaagaucaugaaagacauucuggaaaagaaagucgagaagguggucguguccaacagacucguuaccucuccguguugcaucgugaccagcacauauggcuggaccgccaauauggagcgcauuaugaaagcccaggcucugcgggauaacuccacaaugggguacauggcggccaagaagcaccuggaaaucaauccugaccauagcauuaucgagacgcuuagacagaaagcugaagccgauaagaacgacaaaucugucaaggaccucgugauccugcuguaugagaccgcccuccuguccagcggauuuucucuugaggauccccaaacacacgcuaaucgcauuuaccggaugaucaaacugggccucggcauugacgaagaugacccuaccgccgaugacacauccgcggcuguuaccgaggaaaugccuccccuggagggggaugacgauacgagcagaauggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4334 - RNA, 686 nt, Artificial Sequence
  mRNA product Design3 comprising derived and/or modified sequence from Homo sapiens__NG_005218__HsHSP90AA3P (opt5)
gggagagucccgcagucggcguccagcggcucugcuuguucgugugugugucguugcaggccuuauucaagcuuaccauggacagcuccaagcuggauucuggcaaagggcuccacaucaaccuggugcccaauaagcagaaccaaacccuuacaauugucgacacgagaaucggaaugaccaaaacagaucugauuaauaaccucggcaccguuacaaagagcgggaccaaagccuucauggaggcucugcaggccgacgcggauaucuccaugauuggacauuuuggcgugggguucuacucugcuuaucuuguggccaagaaggucacagugaucagcaaacacaauaacgacgaacaguacaccugggaguccucugccggaggcagcuuuacgguucggaccgaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4335 - RNA, 2522 nt, Artificial Sequence
  mRNA product Design3 comprising derived and/or modified sequence from Homo sapiens__NP_031381.2__HsHSP90AB1 (opt5)
gggagagucccgcagucggcguccagcggcucugcuuguucgugugugugucguugcaggccuuauucaagcuuaccaugcccgaggaagugcaccauggcgaggaagaggucgaaaccuucgccuuucaggcugagaucgcccaacugaugagccucauuaucaacacauucuacuccaauaaggagauuuuucugagagaacuuaucucuaacgcgagcgacgcucuggauaaaauucgguaugagucccucacggacccuucuaagcuggauagcgggaaagaacuuaagaucgacaucauuccgaauccccaggagcgcacccugacacucguugauaccggaaucggcaugacaaaagccgaccugauuaacaaucuggggaccaucgccaaguccggaacaaaggcuuucauggaggcccuccaggcuggcgccgauauuucuaugaucgggcaguuuggagugggcuucuacagcgcguaucugguggccgaaaaagucgugguuauuaccaagcacaacgacgaugagcaauacgcuugggaauccagcgccggcgggucuuuuacggugagagcugaccauggagagccuaucggccgggggaccaaagucauccuucaccugaaggaagaucagacagaguaucucgaggaacgcagagugaaagagguugugaagaagcauucccaguucauuggauaccccaucacccuguaucuugaaaaagagcgggaaaaggagauuagcgacgaugaggccgaagaggaaaaaggcgagaaggaagaggaggacaaagacgaugaagagaagccuaaaaucgaagacgucgggucugaugaggaggacgauuccggaaaggacaagaaaaagaaaacaaagaaaauuaaggaaaaguacaucgaucaggaggaacugaauaaaaccaagcccaucuggacgcgcaacccugacgauauuacacaagaggaauacggcgaguuuuauaaaagccucaccaaugacugggaggaucaccuggcggugaagcacuucucuguggaaggccagcuggaguuuagagcccuccuguucaucccgcggcgcgcucccuuugaccuuuucgaaaacaaaaagaagaaaaauaacauuaagcuguacgucagacggguuuucaucauggacuccugcgaugagcucauuccugaauaucugaauuuuauccgcggggugguggacagcgaggaucuuccccugaacaucuccagagagaugcuccagcagucuaaaauucugaaggucauccggaaaaauauugugaagaagugucuggaacucuucagcgagcuggccgaagacaaagagaacuacaagaaauuuuaugaggcuuucuccaagaaccuuaaacugggaauccaugaggauagcacaaaucgcagacggcucucugagcugcuuagauaccacaccucccaaagcggcgacgaaaugaccucucugagcgaguauguuucccgcaugaaggaaacacagaaaucuauuuacuacaucacgggggagagcaaggaacagguggccaacuccgccuuugucgaacgggugagaaagcgcggauucgagguuguguauaugaccgaaccuauugaugaguacugcguccaacagcucaaagaauuugacggcaagagccuggugucugucacaaaagaggggcuggagcuccccgaagaugaggaagagaagaaaaagauggaagaguccaaggcuaaauucgagaaucuguguaaacuuaugaaggaaauccuggacaagaaaguggagaagguuaccaucagcaaccggcucgugucuuccccgugcuguauugucacaagcaccuauggauggacggcgaauauggaaagaaucaugaaggcccaggcucugcgcgauaacuccacaaugggcuacaugauggccaaaaagcaucuggagauuaauccugaccaccccaucguggaaacccuucggcagaaagccgaggcugauaagaacgacaaagccguuaaggaccucgugguccugcuguuugagaccgcgcuccugucuagcggcuucucccuugaagauccucaaacacacucuaauagaauuuaucgcaugaucaagcuggggcucggaaucgacgaggaugaaguggcugccgaggagcccaacgccgcugugcccgacgaaauuccuccgcuggagggcgaugaagacgccagccggauggaggaaguugauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4336 - RNA, 2759 nt, Artificial Sequence
  mRNA product Design3 comprising derived and/or modified sequence from Homo sapiens__NP_003290.1__HsHSP90B1 (opt5)
gggagagucccgcagucggcguccagcggcucugcuuguucgugugugugucguugcaggccuuauucaagcuuaccaugagagcccugugggugcucggccugugcuguguccuucugaccuucgggagcguucgggcugacgaugagguggacguggauggaacagucgaagaggaccucggcaagucccgcgaagggucuagaacggaugacgaggugguucagcgggaagaggaggccauccaacuggauggacuuaacgcgagccagauucgcgaacugagagagaaauccgaaaaguuugcuuuccaggccgaggugaaucggaugaugaaacucaucauuaacucucuguacaagaauaaagagaucuuucugcgcgaacucauuagcaacgccuccgacgcucuggauaagaucagacuuaucucucugaccgacgagaaugcccucagcggcaacgaagaacugacagucaagauuaaaugcgauaaggagaaaaaucuucugcacgugaccgacacagggguuggaaugacccgggaggagcucgugaagaaccugggcacaaucgcuaaauccggcaccagcgaguuccugaauaagaugacggaggcccaggaagaugggcaaucuaccuccgagcucauuggacaguuuggcgucggguucuauagcgcguuucugguggccgacaaggugaucgucacaucuaaacauaacaaugacacccagcacauuugggaauccgauagcaacgaguucucuguuaucgcugacccccgcggaaauacacuuggcagagggaccacgauuacacuggugcucaaggaggaagccuccgauuaccuggagcuugacaccaucaaaaaccuggugaagaaauauagccaguuuaucaauuucccuauuuacgucugguccucuaagacagaaaccguggaggaaccgauggaggaggaagaggcugccaaagaagagaaggaggaaagcgaugacgaggcggccguugaagaggaagaggaggaaaagaaacccaagaccaaaaagguggagaaaacagucugggauugggaacucaugaacgacaucaagccuauuuggcaacggcccuccaaggagguggaagaggaugaguauaaagccuuuuacaagagcuucucuaaagaauccgacgauccuauggcuuauauccauuuuacggcugagggagaaguuaccuucaagagcauucuguucgugcccacaucugccccucgcggccuguuugacgaguacggcagcaaaaaguccgacuacaucaagcucuaugucagacggguguucaucaccgaugacuuucacgauaugaugccgaaauaccugaacuucgucaagggggugguugacucugaugaccuuccccugaaugugagccgcgaaacacuccagcagcauaaacugcuuaaggucauucggaaaaagcuggugagaaagacccucgauaugaucaaaaagauugccgacgauaaauauaacgacacguuuuggaaggaguucggaacaaauaucaaacugggcguuauugaggaucacuccaacagaacccgccuggcuaagcuccugcgguuucagagcucucaccauccuaccgacaucacaucccuugaucaauacguggaaagaaugaaagagaagcaggacaagaucuauuucauggcggggagcucucgcaaagaagccgaguccagccccuuugucgagcggcugcucaagaaaggauacgaagugauuuaucugaccgagccuguggacgaauacuguauccaggcucugcccgaguucgauggcaagagauuucaaaauguugccaaagaaggggucaaguucgacgaguccgagaagacaaaagaaucucgcgaggccguggaaaaggaguuugaaccgcuucucaacuggaugaaagauaaggcucugaaagacaagauugagaaggccguggucagccagcggcugacggaguccccuugcgcgcucguggcuucucaguacggauggagcggcaauauggaaagaaucaugaaagcccaggccuaucaaaccggcaaggauauuuccacaaacuacuaugcuagccagaaaaagaccuucgagaucaauccccgccacccucugauucgggacaugcuuagacgcaucaaagaagaugaggacgauaagacaguucuggaccucgccgugguccuguucgaaaccgcuacgcugcggucuggguaccuucuccccgauaccaaggccuauggagacagaaucgagcggaugcugcgccugucccucaacauugaucccgacgcgaaaguggaggaagaaccugaagaggagccggaagagacagccgaagacaccacagaggauaccgaacaggacgaggaugaggaaauggacguuggcacggaugaggaagaggaaacagcuaaggagagcaccgccgagaaagacgaacugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4337 - RNA, 2462 nt, Artificial Sequence
  mRNA product Design3 comprising derived and/or modified sequence from Homo sapiens__NP_057376.2__HsTRAP1 (opt5)
gggagagucccgcagucggcguccagcggcucugcuuguucgugugugugucguugcaggccuuauucaagcuuaccauggccagagagcugcgggcucuccugcuuuggggccgcagacugcggccccuccugcgcgccccugcgcuugcugccgugcccgggggaaagccgauccugugcccuagacggaccacagcccagcucggcccccgcagaaacccugcuuggagccugcaagccgggcggcuguucuccacgcagaccgcugaagacaaagaggaaccccuccacucuauuaucagcuccacagagucuguccagggaagcaccuccaagcaugaauuucaggccgagacaaagaagcugcuugauauuguugcgcgcucucuguacagcgagaaagaaguguucaucagagagcucauuuccaaugccagcgacgcucuggaaaaacuucggcacaagcuggugucugauggccaagcccucccugagauggagauccaucugcagaccaacgcugaaaaagggacaaucaccauucaggacacgggaaucggcaugacccaggaggaacuggucuccaaucucggcacaauugcccgcagcgggucuaaggcguuucuggaugcccuucaaaaccaggcugaggccuccagcaaaaucauuggacaguucggcgugggguuuuauucugcuuucaugguugccgacagaguggaagucuacucccggagcgccgcuccgggaucccugggcuaucaguggcucucugaugggagcggaguguuugagaucgcggaggccuccggcguucgcaccggcacaaagauuaucauccaccugaaaagcgacuguaaggaguucucuuccgaggcuagagugcgggaugucgugaccaaguacagcaauuuugugucuuucccccuuuaucugaacgggagacgcaugaauacgcuccaagccauuuggaugauggacccuaaagauguccgggaauggcagcaugaggaauuuuacagauauguugcccaggcucacgacaagccccgcuacacacugcacuacaaaaccgaugccccucugaacauccggagcauuuucuaugugcccgacaugaagccguccauguuugacgugucuagagagcucggaagcuccgucgcgcuguacagccgcaaagugcuuauccaaacaaaggcuaccgauauucugccuaaauggcuccgguucaucagaggcguuguggacucugaggauaucccccugaaucuuucccgcgaacugcuccaggagagcgcccugauucggaagcugagagacguccuccagcagcgccugaucaaguucuuuauugaucaaucuaaaaaggacgccgaaaaauaugcuaaguucuuugaggauuacgggcuuuucaugcgggaaggaaucgugaccgccacagagcaggagguuaaagaagacauugcuaagcugcucagauaugaguccagcgcccugccuuccggccagcugacgucucuuagcgaauacgcgucccggaugcgcgccgggaccagaaacaucuauuaccucugcgcucccaaucggcaucuggccgagcacucucccuacuaugaggcuaugaagaaaaaggauacagaagugcuguuuuguuucgagcaguuugacgaacucacccugcuucaucugagagaguucgauaaaaagaaacucaucagcgucgaaacagacauuguggucgaccacuacaaggaggagaaguuugaagaucgcuccccugccgcggagugccugagcgaaaaagagaccgaagaacugauggccuggaugcggaacgugcuuggaucuagaguuacgaaugugaaggucacacuccgccuggacacccacccggcuauggugaccguucuggagaugggcgccgcuagacauuuccuccggaugcaacagcuggccaaaacacaggaggaacgcgcccagcuucugcaacccacccucgaaaucaacccuagacacgcucugauuaagaaacugaaucagcuucgggcguccgagcccggccucgcccagcugcugguggaucagaucuaugaaaacgcuaugauugccgccgggcucgucgacgauccucgcgcuauggugggaagacugaacgagcuucuggugaaggcccucgagcggcauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4338 - RNA, 809 nt, Artificial Sequence
  mRNA product Design3 comprising derived and/or modified sequence from Homo sapiens__NP_000609.1__HsIGF1 (opt5)
gggagagucccgcagucggcguccagcggcucugcuuguucgugugugugucguugcaggccuuauucaagcuuaccaugggcaagaucagcucccugcccacccagcuuuucaaaugcuguuuuugcgacuuccugaaggugaaaaugcacacaaugucuagcucccaucucuuuuaccuggcccucugucugcuuacguucaccucuagcgcuacagccgggccugagacccugugcggagcggaacucgucgaugcucugcaauuuguuuguggcgacagaggguucuauuuuaacaagccgacaggauacggcuccucuagccggcgcgcuccccagaccgggauuguggaugagugcuguuucagauccugcgaccugcggcgccucgaaauguauugugccccucugaaacccgccaagagcgccagaucugugcgggcucagcgccacacagauaugccuaagacccagaaagagguccaucuuaagaaugccuccagaggaagcgcgggcaacaaaaauuaccggaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4339 - RNA, 890 nt, Artificial Sequence
  mRNA product Design3 comprising derived and/or modified sequence from Homo sapiens__NP_000603.1__HsIGF2 (opt5)
gggagagucccgcagucggcguccagcggcucugcuuguucgugugugugucguugcaggccuuauucaagcuuaccaugggcauccccaugggaaagagcaugcuggugcuccugaccuuccuugccuuugcuuccugcuguauugccgcguacagaccuucugagacacugugcgggggcgaacucgucgacacgcugcaguucguuuguggggaucggggauuuuauuucagccgcccggcuuccagagugucucggcgcagcagaggcaucguggaggaaugcuguuuucgguccugcgaccuugcccugcucgagaccuacugugccacacccgcuaaaucugaacgcgaugucagcaccccucccacagugcugccugacaacuuccccagauauccuguugggaaguuuuuccaauacgauaccuggaaacaguccacacagcggcugcgcagaggacucccggcccugcuucgggcucgcagaggccacgugcuggccaaggagcucgaggcguuucgggaagccaaacgccauagaccccugauugcccuuccuacccaggaccccgcucacggcggggcuccucccgagauggccagcaaucggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4340 - RNA, 986 nt, Artificial Sequence
  mRNA product Design3 comprising derived and/or modified sequence from Homo sapiens__NP_000591.1__HsIL6 (opt5)
gggagagucccgcagucggcguccagcggcucugcuuguucgugugugugucguugcaggccuuauucaagcuuaccaugaacagcuucuccaccucugccuuuggccccguggcuuucagccuggggcuccugcuuguccugccugccgcguuuccggcucccguuccucccggagaggacuccaaggauguggccgccccucacagacagccccucacaucuagcgaacggaucgacaaacaaauucgcuacauccuggauggcauuuccgcucuuagaaaggagacgugcaauaaaucuaacaugugugaaagcuccaaggaggcccuggcugaaaauaaccucaaucugccuaaaauggccgagaaggacgggugcuuccagagcggauuuaacgaggaaaccugucuggugaagaucauuacaggccuccuggaguucgaagucuaucuugaguaccugcagaaucgguuugagucuuccgaagaacaggcgcgcgccgugcaaaugagcaccaaaguucucauccaguuccugcagaagaaagcuaagaaccuugaugccaucacaaccccggaccccacaaccaaugcuucucugcucacgaaacugcaggcccaaaaccaguggcugcaggauaugaccacacaucucauucugagauccuuuaaggaguuccuucagagcucucugcgggcgcuccgccaaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4341 - RNA, 1628 nt, Artificial Sequence
  mRNA product Design3 comprising derived and/or modified sequence from Homo sapiens__NP_002183.1__HsINHBA (opt5)
gggagagucccgcagucggcguccagcggcucugcuuguucgugugugugucguugcaggccuuauucaagcuuaccaugccccugcucuggcugagaggcuuccuucuggccagcugcuggaucauugugcgguccucuccuaccccggggagcgagggacacuccgcugcccccgacuguccuucuugcgcgcucgcugcccugcccaaggaugucccuaacagccagcccgaaaugguugaggccgugaaaaagcauauccuuaauaugcugcaccucaaaaagcgcccugacgugacacaaccgguccccaaagcugcccugcugaacgcuauuagaaagcuccaugugggcaagguuggggaaaauggauacguggagaucgaagaugacauuggccggcgcgccgagaugaacgagcugauggaacagacguccgagaucaucaccuuugcggaaucugggacagccagaaaaacccuucacuucgagauuagcaaggagggauccgaucugagcgucguggaacgggcugagguuuggcucuuucugaaagugccuaaggccaaucgcacaagaaccaaagucacaauccggcuuuuccagcagcaaaagcauccccagggcucucuggacaccggcgaagaggcugaagagguggggcucaagggagagcgcuccgaacugcugcucagcgagaaaguggucgaugccagaaagucuacguggcacguuuuuccuguguccagcucuauucagcggcugcuugaccagggcaaauccagccuggaugugcgcaucgcgugugaacaaugccaggaguccggggccucucucguccugcuuggaaagaaaaagaaaaaggaagaggagggcgaagggaagaaaaagggaggcggcgaagggggagcuggcgccgacgaggagaaagaacagagccacagacccuuccugaugcuccaggcucggcaauccgaggaucauccgcaccgcagacggagacgcgggcuggagugugacggaaaggugaacauuugcuguaaaaagcaguuuuucguuagcuuuaaggauaucggcuggaaugacuggauuaucgccccuucuggguaucaugccaacuacugcgaaggagagugucccucccacaucgcuggcaccagcggcucuagccuguccuuccacucuacagugauuaaucauuaucggaugagagggcacagcccuuuugcgaaccucaaauccugcuguguccccaccaagcugcgccccaugagcaugcuuuacuaugacgauggacagaauaucauuaaaaaggacauccaaaacaugauuguggaagagugcggcugcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4342 - RNA, 1571 nt, Artificial Sequence
  mRNA product Design3 comprising derived and/or modified sequence from Homo sapiens__NP_002184.2__HsINHBB (opt5)
gggagagucccgcagucggcguccagcggcucugcuuguucgugugugugucguugcaggccuuauucaagcuuaccauggacggccugcccgggagagcccucggagcugccugccugcuucugcucgcggcuggcuggcuggggccugaggccuggggaagcccgacacccccucccaccccugccgcucccccuccgcccccucccccuggcucccccgggggaucucaggauacguguaccagcugcggcggcuuccggcgcccggaggaacuugggagaguggacggagauuuucuggaagccgucaagcggcacauccucucccgccugcaaaugagaggccggccuaacauuacacaugcuguucccaaagccgcgauggugaccgcccugcgcaagcuccacgcugggaaagugagagaggacggacgggucgaaaucccucaucuggauggccacgccucucccggggcugacggacaggagcgcgugagcgagauuaucuccuucgccgaaacagauggccuugcgucuagcagaguucggcuguacuuuuucauuuccaaugagggcaaccagaaucucuuugugguccaggccagccuguggcuuuaucugaagcuccugcccuacgugcuggaaaaagggucucgcagaaagguucgggugaaggucuauuuccaagagcagggacauggcgaccgcuggaacaugguggagaaaagaguggaucucaagcgguccggguggcacaccuuuccucugacagaagcuauccaggcccuuuucgagagaggagaacgccggcugaaucucgacguccagugugauagcugccaagagcuggcuguugugccgguguuugucgaccccggcgaagagucucacagaccuuucgugguugugcaggcccgccuuggggauucccggcauagaauccgcaaacggggacuggagugugacggcagaaccaaccucugcugucgccagcaguuuuucauugacuuucggcugaucggcuggaaugauuggauuaucgcccccacgggguacuauggaaacuacugcgaaggcagcuguccugcuuaucuggcggggguccccggaucugccuccagcuuccacaccgcugugguuaaucaauacagaaugcgcggccucaacccggggacagucaauuccugcuguauuccuaccaagcugucuacaaugagcaugcuuuacuucgacgaugaguauaacaucgugaaacgggacgugcccaauaugauugucgaagagugcggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4343 - RNA, 3806 nt, Artificial Sequence
  mRNA product Design3 comprising derived and/or modified sequence from Homo sapiens__NP_000623.2__HsITGAM (opt5)
gggagagucccgcagucggcguccagcggcucugcuuguucgugugugugucguugcaggccuuauucaagcuuaccauggcccugagagugcuccugcuuaccgcucugacacucugccacggcuucaaccuggacacggagaaugccaugaccuuucaggaaaacgcgcggggguucggacaaagcgugguucagcuucagggcucccgcgugguggucggggcuccccaggagaucguggccgccaaucaaagaggaucucuguaccagugugauuauagcacaggcuccugcgaaccuauucggcuccagguuccgguggaggcugucaacaugucucuggggcugagccucgccgcuaccacauccccuccucagcugcuugccuguggacccaccgugcaucaaacaugcucugaaaauaccuacguuaagggccuguguuuucucuucggcagcaaccugcgccagcagccucagaaauuucccgaggcgcuuagagggugcccucaagaggacuccgauaucgccuuccugauugacggaagcggcucuaucauuccgcacgauuuucggcgcaugaaggaguucguguccacggucauggaacagcucaaaaagagcaaaacccuguuuucucugaugcaguauuccgaagaguucagaauccauuuuacauucaaggaguuucaaaauaaccccaauccucggagccucgugaagcccaucacccagcugcuugggcgcacacacaccgcuacgggaauuagaaaagugguccgggaacuguucaacaucacaaauggcgcccgcaagaacgcuuucaaaauucucguugugaucaccgacggggagaaguuuggagauccucugggcuacgaagacgugauucccgaggccgauagagaaggcgucauccgguaugugauugggguuggagacgcguuccgcucugagaaauccagacaggagcuuaauacaaucgccagcaagccgccucgggaucauguguuucaggucaacaauuucgaagcucugaagaccauccaaaaccagcucagagagaaaauuuuugccaucgaaggcacccagacaggguccucuagcuccuucgagcacgaaaugagccaggagggauuuucugcugccauuacguccaacggcccccugcugagcaccguggggucuuacgacugggccggaggcguuuuccucuauacaagcaaggagaaauccaccuuuaucaauaugacacgcguggauucugacaugaacgacgcuuaccugggcuacgcggccgcuauuauccuucggaauagaguccaaagccuggugcucggggccccucgcuaucagcacaucggacuggucgccauguuccggcagaacaccggcaugugggaauccaaugcuaacgugaaggggacgcagauuggagccuacuuuggcgcgagccuuuguucuguugauguggacuccaaugggagcacagaucugguccucaucggcgcuccccauuauuacgagcaaaccagaggaggccaggugucuguuugcccccugccucgcgggcgggccagauggcagugugacgccgugcuguauggagaacagggccaaccgugggggcgcuucggagcugcccucaccguccugggcgaugugaacggggacaaacuuacagauguggcuauuggcgcccccggagaggaagacaaucggggcgcgguuuaccuguuucacgggaccuccggaagcggcaucuccccuucucauagccagagaauugccggguccaagcucucuccccgccugcaguauuucggacaaagccuguccggcgggcaggaucuuacaauggacggccucgucgaucugacggugggagcucagggccacgugcugcuccugcggagccagccuguccuuagagugaaagccaucauggaguucaacccccgggagguugcucgcaauguguuugaaugcaacgaccaagucgugaaggggaaggaggccggagaaguuagagugugucugcacguccagaaaucuacccgggacagacuccgcgagggccagauccaguccgugguuacauacgaucuggcgcuggacagcgggcggccgcauucuagagccguguucaaugagaccaagaacuccacacgcagacaaacccagguccuuggacucacgcagaccugcgaaacacugaaacugcagcucccuaauugcauugaggaucccgugagcccuaucgugcugcggcuuaacuuuucucuggucggcacaccccucagcgcuuucgggaaccugcgcccuguucuggccgaagacgcucaaagacuuuuuaccgcccucuuccccuuugagaagaauuguggcaacgauaauauuugccaggacgaucuguccaucaccuucagcuuuaugucucuggacugucucguggugggaggcccgcgggaguucaacgucacggugacaguucgcaaugauggggaagacuccuacagaacccaggugacauuuuucuuuccucuggaucuuagcuaucggaaagucuccacccugcaaaaccagcgcucucagagaagcuggcggcucgccugcgaguccgcuucuagcaccgaaguguccggagcgcugaagucuacaagcuguuccauuaaucaccccaucuuccccgagaacagcgaaguuacguucaauauuaccuuugacguggauucuaaggccucccugggcaacaaacuucuccugaaggcuaaugucacaagcgagaacaauaugccucgcaccaacaaaacagaguuccagcuggaacucccggugaaguacgccguuuauaugguggucaccucucaugggguguccacgaaauaccugaauuuuacagccagcgagaacaccucuagagugaugcaacaccaguaucaggucuccaaccuuggacagcggagccugcccaucucccucguuuuccuggugccugugagacugaaucaaaccgucaucugggaccgcccccaggugacauuuagcgaaaaccuuucuagcacaugccauaccaaggagcggcugccuucccacucugacuuccucgcugaacugagaaaggcccccguugugaauuguagcauugcggucugccagcgcauccagugugauauucccuuuuucggcauccaagaggaauuuaacgcuacgcucaaaggcaaucuguccuucgacugguacauuaagaccucucacaaccaucuucugaucgugagcacagccgagauccucuuuaaugauuccguuuucacccugcugcccgggcagggagccuucgugcggucucagacagagaccaaagucgaaccguuugaggugccuaacccccuuccucugauugucggcagcuccgucgggggacuccugcuccuggcucuuaucacggccgcgcuguauaagcucggcuucuuuaaaagacaguacaaggacaugaugagcgaagggggacccccgggcgcugagccucaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4344 - RNA, 1751 nt, Artificial Sequence
  mRNA product Design3 comprising derived and/or modified sequence from Homo sapiens__NP_002415.1__HsMMP8 (opt5)
gggagagucccgcagucggcguccagcggcucugcuuguucgugugugugucguugcaggccuuauucaagcuuaccauguucagccugaagacccuccccuuucugcuucugcuccacgugcagaucuccaaagccuucccugucucuagcaaggagaaaaacacaaagacgguucaagacuaccuggaaaaauuuuaucagcuuccguccaaucaguaccagucuaccagaaagaacggcacaaaugugauuguggagaagcugaaagaaaugcaacgguucuuugggcucaacgucaccggaaagcccaaugaggaaacacuggauaugaugaaaaagccucgcugcggcgugcccgacagcgggggauucaugcugaccccuggcaaccccaaaugggagagaacaaaucucaccuaucggauccgcaacuacacgccucagcuguccgaggcugaaguugagagagccauuaaggaugcguuugaacuuuggucuguggcuagcccgcugaucuucacccggauuucccagggggaggccgacaucaauaucgccuuuuaucagcgcgaucauggagacaacagccccuucgauggcccuaauggcauucucgcucacgccuuucaacccgggcagggaaucggcggggacgcucauuucgaugccgaggaaacauggaccaacacaucugcgaauuacaaccuguuucuugucgccgcucacgaguucggacauucccugggccucgcccacagcucugacccuggggcucugauguaucccaauuacgccuucagagaaaccuccaacuacagccugccgcaggaugacauugauggaauccaggcgauuuauggccucucuuccaacccuauccaacccacgggcccuagcacacccaagcccugugacccuucccugaccuuugacgccauuacaacccuucggggagagauccuguucuuuaaagaucgcuacuucuggagacggcacccgcagcuccagcgcguggaaaugaauuuuaucucucuguucuggcccagccuuccuaccgggauucaagcugccuaugaggacuuugauagagaccugaucuuccucuuuaagggcaaccaguacugggcucuguccggguaugauauucugcagggauaccccaaagacaucagcaauuauggcuucccuucuuccguucaggccauugaugccgcuguguuuuaccggagcaagacauacuucuuugucaacgaccaauucuggcgcuaugauaaucagagacaguucauggagcccggguacccgaaaucuaucagcggagcguuuccuggcaucgaauccaagguggacgccguguuccagcaagagcacuuuuuccaugucuuuucuggcccccgguauuacgcuuucgaucucauugcccagagaguuacgcgcguggcccgggggaacaaauggcugaauugcagauauggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4345 - RNA, 2471 nt, Artificial Sequence
  mRNA product Design3 comprising derived and/or modified sequence from Homo sapiens__NP_004985.2__HsMMP9 (opt5)
gggagagucccgcagucggcguccagcggcucugcuuguucgugugugugucguugcaggccuuauucaagcuuaccaugagccuguggcagccccucgugcugguccuucugguucucggcugcuguuucgccgcuccuagacaacggcaguccacccuggugcuuuuuccgggggaccugcgcacaaaccucacggauagacagcuggccgaggaauaccuguaucgguacggauauacccgcguggcggagaugagaggcgaaucuaaaagccucgggcccgcucugcuucugcuccagaaacaacugucccuuccugagacaggagaacuggacucugccacccucaaggccaugcggacaccccgcugcggcgucccugaucuggggagauuccagaccuuugagggagaccugaaauggcaccaucacaauaucacauacuggauucagaacuauagcgaggaucucccccgggcugugaucgacgaugccuucgcucgcgccuuugcgcugugguccgccguuaccccucuuacguucaccagaguguacucucgggacgcugauauugucauccaguuuggcguggccgaacauggcgacggguauccguucgauggaaaggacggccugcucgcucacgccuuucccccugggcccgggauucaaggcgaugcgcauuucgacgacgaugagcuguggagccuugggaaaggaguuguggucccuacacgcuuuggcaaugccgacggcgcugccugucacuuccccuuuaucuucgaagggagauccuacagcgcuugcaccacagauggacggucugacggccugccgugguguuccaccacggccaacuacgauacagacgaucgcuucggguuuugcccuagcgagagacucuauacccaggacggaaaugccgauggcaagcccugucaguucccuuuuaucuuccaggggcaaucuuacuccgcuugcacaaccgacggacggagcgauggcuauagauggugugcgaccacagccaacuacgaccgcgacaagcuguuuggcuucugccccacgcgggcugauucuaccgugaugggaggaaauuccgccggcgagcuguguguguuucccuucacauuucucgggaaagaauauagcacaugcaccuccgagggaagaggcgacgggcgccuguggugcgccaccacgucuaacuucgauagcgacaagaaauggggcuuuuguccugaucagggauacucccuuuuccuggucgcugcccacgaauuuggccaugcgcucgggcuggaccacagcucuguuccggaggcucuuauguaucccauguaccgguucacagaaggaccuccccugcauaaggaugacgugaauggcauuagacaccucuacgggccucgccccgagccggagccucggcccccuaccaccacaacaccccagccuaccgcgcccccgacggugugcccuaccggaccucccacaguccaccccuccgaaagaccgaccgccggccccacagggccucccagcgcuggcccuaccggacccccuacggccggccccucuaccgcuacaaccgugccgcugagcccuguugaugacgccuguaacgugaauaucuucgaugcgauugccgagaucgggaaccaacuguaucucuuuaaagacggaaaguacuggcgcuucuccgaaggccgggggucuagaccccagggaccuuuucugauugcugauaaguggcccgcccuuccgcgcaaacuggacagcgucuucgaggaacggcucuccaagaaacuguuuuucuuuagcggcagacagguguggguuuauacaggggcuucugugcugggcccucggcgccuugacaagcucggacugggcgccgaugucgcccaggugaccggggcccugagauccggacggggcaaaaugcuccuguucagcgggagacgccuuuggcgguuugacgucaaggcucaaaugguggaucccagaucugccuccgagguugaccgcauguucccuggagugccccuggauacgcaugacgucuuucaguacagagagaaggcuuauuucugccaggaucgguuuuacuggcgcgugagcuccagaucugaacucaaucagguugaccaagugggcuaugucacauacgauauccugcagugucccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4346 - RNA, 1763 nt, Artificial Sequence
  mRNA product Design3 comprising derived and/or modified sequence from Homo sapiens__NP_002418.1__HsMMP13 (opt5)
gggagagucccgcagucggcguccagcggcucugcuuguucgugugugugucguugcaggccuuauucaagcuuaccaugcaccccggcgugcuggccgcuuuccucuuucugagcuggacccauugcagagcccuuccucugccguccgggggagacgaggaugaccucucugaagaggaucugcaguucgcggaacgguaccuucgcagcuauuaccaccccacaaaccuggcuggcauccucaaggagaaugccgccuccucuaugacggaaagacugcgggagaugcagagcuuuuucgggcuggaggucaccggaaaacucgacgauaacacacuggacguuaugaagaaaccucgcuguggcgugcccgaugugggggaauauaaugucuuuccuagaacccuuaagugguccaaaaugaaccugacauaccggauugugaauuauacccccgacaugacacauucugagguugaaaaggcuuucaagaaagccuuuaagguguggagcgaugucaccccucucaacuucacgcgccugcacgacggaaucgcugauauuaugaucuccuuuggcauuaaagagcauggcgacuucuacccguuugaugggcccagcggacuucuggcccacgcguucccucccggcccuaauuaugggggagacgcccacuuugacgaugacgagaccuggacaucuuccagcaagggcuacaaccucuuccugguggcugcccaugaguucgggcacucucugggacucgaucauuccaaagaccccggcgcucugauguuuccgaucuacaccuauacaggcaagagccacuucaugcuuccugaugacgauguucaagggauccagucucuguacggacccggcgacgaggauccuaaucccaagcaccccaaaaccccugacaagugcgauccgucccucagccuggacgccauuacgucccuuagaggggaaacaaugaucuuuaaagaccgguucuuuuggcgccugcauccccagcaaguggaugcggaacucuuccugaccaagucuuuuuggccugaacugcccaacagaauugacgccgcuuaugagcacccuagccaugaucucaucuucauuuuucggggacgcaaauucugggcccugaauggcuacgacauccuugagggguaucccaagaaaauuuccgaacugggacucccgaaggaggucaagaaaaucagcgcugccgugcacuuugaagauacaggcaagacccugcuuuucucuggcaaccagguguggagauacgacgauaccaaucauaucauggacaaagauuauccucggcugauugaggaagacuuucccgggaucggagauaaggucgacgccguuuacgagaaaaacggcuacauuuauuucuucaaugggccuauccaguuugaguacuccauuuggagcaaccgcaucgugagagugaugcccgcuaacucuauccucugguguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4347 - RNA, 1415 nt, Artificial Sequence
  mRNA product Design3 comprising derived and/or modified sequence from Homo sapiens__NP_001286.1__HsCCR1 (opt5)
gggagagucccgcagucggcguccagcggcucugcuuguucgugugugugucguugcaggccuuauucaagcuuaccauggagacccccaacacaacggaagacuacgauaccacaaccgaguucgacuauggcgaugccacaccuugccagaaggugaaugaaagagcuuuuggggcccaacugcucccgccccuguacagccuugucuucguuaucggacuggugggcaacauucucgugguccuggugcuuguucaguauaaacggcugaagaauaugaccuccaucuaccuccugaaccuggcgauuucugaccuccuguuucuuuucacacugccuuuuuggaucgauuauaaacucaaggacgauuggguguucggggacgcuauguguaaaauucugagcggauuuuacuauaccggccuuuacuccgagaucuucuuuaucauucugcucacgaucgaucgcuaccuggccauuguccacgccguguucgcucugagagcccggaccguuacauuuggggugaucaccucuauuaucauuugggcucucgccauccuggcgagcaugcccggacuuuauuucuccaagacacagugggaauuuacccaucacacgugcucucugcauuucccucacgagagccuccgcgaguggaagcuguuccaggcccuuaaacugaaucucuuuggccugguccugccccuccuggugaugaucauuuguuacacaggcaucauuaagauccuucugagacggccuaacgagaaaaaguccaaagcugugcgccucauuuucgucaucaugaucaucuuuuuccuguuuuggaccccguauaaucuuacaauucugauuagcguuuuccaagacuuucucuucacccaugaaugcgaacagucuagacaccuggaucuggccguccaggugaccgaggugaucgcuuacacacacuguugcgugaaccccguuauuuaugccuuugugggggagcgguuccgcaaguaccucagacagcuguuucaucggcgcgucgcggugcaccuuguuaaguggcugccuuuccucuccguggacagacuggaacgggucagcucuacgucccccagcaccggagagcaugaacugucugccggcuuuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4348 - RNA, 983 nt, Artificial Sequence
  mRNA product Design3 comprising derived and/or modified sequence from Homo sapiens__NP_002598.4__HsPDGFA (opt5)
gggagagucccgcagucggcguccagcggcucugcuuguucgugugugugucguugcaggccuuauucaagcuuaccaugagaacccuggccugccuccugcuucugggcuguggguaccucgcucacgugcuggccgaggaagcggagaucccccgggaagucauugagcgccuugcuagaagccagauccauuccauucgggaccugcaacgccuccuggaaaucgauucuguuggaagcgaggacucccuggauacaucucucagagcccacggcgugcaugccacgaagcacgugccugagaaacggccgcugcccauucgcagaaagcggagcaucgaagaggcugucccugccgugugcaaaacccgcacaguuaucuaugaaauucccagaucccagguggacccuaccucugcuaacuuccuuaucuggcccccuugugucgaggugaagcggugcacaggguguugcaauaccagcuccguuaaaugucagccgagccgcgugcaucacagaucugucaagguggccaagguggaguacguccggaaaaagcccaaacugaaggaaguucaggugcgccucgaggaacaccuggagugcgcgugugccacaaccucccuuaacccugauuauagagaagaggacacgggacggcccagagagagcggcaaaaagcgcaagcggaaaagacugaagccuaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4349 - RNA, 1073 nt, Artificial Sequence
  mRNA product Design3 comprising derived and/or modified sequence from Homo sapiens__NP_002599.1__HsPDGFB (opt5)
gggagagucccgcagucggcguccagcggcucugcuuguucgugugugugucguugcaggccuuauucaagcuuaccaugaacagaugcugggcccuguuccucagccuguguugcuaccuucggcugguguccgcugagggcgaccccaucccugaggaacucuaugaaaugcugucugaucacagcauucgcuccuuugacgaucuucagagacugcuccauggggacccgggagaggaagauggcgccgagcuggaccugaauaugacccggucucacagcgggggagagcucgaaucccuggcgcgcggcagacggucucuugggagccugacaaucgcugagcccgccaugauugccgaauguaagacgcgcaccgaggucuucgagaucuccagacggcucauugaucgcacaaacgcuaauuuucugguuuggccucccugcguggaagugcaaagauguagcggaugcuguaacaaucggaacguccagugccgcccuacccaggugcagcuuagacccguucaagugcggaaaaucgagaucguccgcaagaaaccuauuuucaagaaagccacagugacccuggaagaccaucucgcuuguaagugcgagacaguugccgcggccagaccggugacccggucucccggcggcucccaggaacagagagcuaagacgccucagacccgcgucacaauccggaccgugagagugcgccggcccccuaaagggaagcacagaaaauuuaagcauacacacgauaaaaccgcccugaaggagacgcugggagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4350 - RNA, 1385 nt, Artificial Sequence
  mRNA product Design3 comprising derived and/or modified sequence from Homo sapiens__NP_057289.1__HsPDGFC (opt5)
gggagagucccgcagucggcguccagcggcucugcuuguucgugugugugucguugcaggccuuauucaagcuuaccaugagccuguucggccuccugcuucugaccuccgcccucgcugggcagagacaaggaacacaggccgagucuaaccugagcuccaaguuucaguucucuagcaauaaagaacagaacggcgugcaagacccccagcacgagcggaucauuacggucuccaccaaugggucuauccauagcccucgcuuuccgcacacauaccccagaaacaccguucuuguguggcggcugguggcggucgaagagaauguguggauucagcucacauucgaugaacgcuuuggacuggaggacccugaggaugacaucugcaaguaugauuucguugaaguggaggaacccuccgacggcaccauucuggggagaugguguggaagcggcacagucccuggcaaacagaucucuaaggggaaccaaauccggauucgcuuuguguccgaugaguacuuccccagcgagccuggauuuugcauccauuauaauauuguuaugccgcaguucaccgaagcugugucucccuccguccucccucccagcgcccugccucuugaccugcucaacaaugccaucacggcuuuuucuacccuggaggaucuuauuagauaccuggaacccgagcgguggcagcucgaccuggaagaucuguaucgcccgacauggcagcuccugggcaaagccuucguguuugggagaaagucccggguggucgaccuuaaccugcucaccgaggagguucgccuguacagcuguacaccuagaaauuucuccgugucuauccgggaggaacuuaagcgcaccgauacgauuuucuggcccggaugccugcucgugaaaagauguggcgggaacugcgcuuguugccugcacaauuguaacgaaugccaaugugucccuagcaaggugaccaaaaaguaucaugagguucugcagcuccggcccaaaacaggagugagaggccugcacaagucccuuacagacgucgcccuggaacaccaugaggagugcgacugcgugugucgcggcagcaccgggggaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4351 - RNA, 1442 nt, Artificial Sequence
  mRNA product Design3 comprising derived and/or modified sequence from Homo sapiens__NP_149126.1__HsPDGFD (opt5)
gggagagucccgcagucggcguccagcggcucugcuuguucgugugugugucguugcaggccuuauucaagcuuaccaugcacagacugaucuucguguacacccucauuugcgccaacuuuuguagcugccgggacacauccgcuacgccccagucugccagcaucaaggcgcugcgcaaugcuaaccuuagacgggaugaccuguaucgcagagaugagaccauucaagucaaaggcaauggguacguucaguccccucgguucccgaacucuuauccccgcaaucuccugcuuacauggagacugcauagccaggaaaacacccggauccagcucguguuugacaaucaauucggacuggaggaagccgagaacgauauuugucgcuacgacuuuguggaagucgaggauaucuccgagacaucuaccaucauuagaggccgguggugcgggcacaaggaagugccuccccgcaucaaaagcagaacaaaucagauuaagaucaccuucaaauccgacgauuauuuuguugccaagccuggauucaagauuuacuauagccugcucgaggacuuucagcccgcugccgcuucugaaacgaacugggaguccgugaccagcucuaucuccggcgucagcuacaauucuccuuccgugacagauccgacccugauugccgacgcgcuugauaaaaagaucgccgaguucgacacaguugaagaccugcucaaauacuuuaaccccgagagcuggcaggaagaucuggagaauauguaucuugacaccccucgguaccgcgggagauccuaucaugaucggaagucuaaaguggaccuggauagacucaacgacgaugcuaagcgcuacagcuguacgccccggaauuauuccgucaacaucagagaggaacugaagcuggccaacgugguguucuuuccucgcugccuccugguccaacgguguggaggcaauugcggcugugggacaguuaacuggagaagcugcaccuguaauucuggaaaaacagugaagaaauaccacgaggugcuucaguucgaacccggccauauuaagcgccgggggagagcuaaaaccauggcccuggucgacauccagcucgaucaccacgagcgcugcgacugcauuuguuccagccggccgccuagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4352 - RNA, 1025 nt, Artificial Sequence
  mRNA product Design3 comprising derived and/or modified sequence from Homo sapiens__NP_003946.3__HsSOCS3 (opt5)
gggagagucccgcagucggcguccagcggcucugcuuguucgugugugugucguugcaggccuuauucaagcuuaccauggugacccacagcaaguuccccgccgcuggcauguccagaccucuggacacaucucuccggcugaaaacguuuagcuccaagucugaguaccagcuugucguuaacgccgugcgcaaacugcaagaaagcggguucuauugguccgcggugaccggaggcgaggcuaaucuccugcuuucugccgaaccggccgggacauuucugaucagagauagcuccgaccagcggcauuucuuuacccucagcgucaagacacagucuggaaccaaaaaccugcgcauucagugcgagggcggguccuucagccugcaaucugaucccagauccacacagccugugccccgguuugacuguguucucaagcuggugcaccauuacaugccucccccuggagcuccgagcuuccccucuccucccaccgaaccuuccagcgagguccccgagcagccguccgcccagccucuucccggcucuccuccccgcagagcuuauuacaucuauagcggcggggaaaagauuccccuggugcucucccggccucugagcucuaauguugccacgcuucaacaccugugccgcaaaaccgugaacggacaucucgauuccuacgagaaggucacacagcugccgggccccaucagagaauuucuggaccaguaugaugcgccucucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4353 - RNA, 830 nt, Artificial Sequence
  mRNA product Design3 comprising derived and/or modified sequence from Homo sapiens__NP_003227.1__HsTGFA (opt5)
gggagagucccgcagucggcguccagcggcucugcuuguucgugugugugucguugcaggccuuauucaagcuuaccauggugcccagcgccggccagcuggcucucuucgcccuggggaucguccuugcggcuugccaagcccuggagaacuccaccucuccucucagcgccgacccgcccguugcugccgcuguggugucccacuuuaaugauuguccugacucucauacacaguucugcuuucacggaacguguagauuccugguccaggaagauaagcccgccugcgugugucauagcggcuacguuggggcgcggugcgagcacgccgaccuucuggcuguggucgccgcuucccagaaaaagcaagccauuaccgcgcucgugguugugucuaucgucgcccuggcugugcugauuaucacaugugugcucauucauugcugucagguccgcaaacacugcgaaugguguagagcccugaucugccggcacgagaagccuagcgcccuucugaaaggacgcaccgcuugcugucauuccgaaacaguugugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4354 - RNA, 1520 nt, Artificial Sequence
  mRNA product Design3 comprising derived and/or modified sequence from Homo sapiens__NP_000651.3__HsTGFB1 (opt5)
gggagagucccgcagucggcguccagcggcucugcuuguucgugugugugucguugcaggccuuauucaagcuuaccaugcccccuagcggccugagacuccugccgcuucugcucccccugcuuuggcugcucgugcugaccccugggcggcccgccgcuggacuguccacaugcaagacgaucgacauggagcucgucaaacgcaagagaauugaagccauccggggccagauucugucuaaacuucgccuggcgagcccucccucccaaggggagguuccuccgggaccccucccugaagcugugcuggcccuuuacaacucuaccagagaucggguggccggcgagagcgcugaacccgagccugagcccgaagccgacuauuacgcuaaggaggucacacgcgugcugaugguugaaacccacaaugagaucuaugauaaauucaagcaguccacacauucuauuuacauguuuuucaacaccagcgagcucagagaagccgugccggagccuguccugcugucccgggcggaacuccgccugcuuagacugaagcucaaaguggagcagcacguugaacuguaucagaaguacagcaauaacucuuggcgguaucuuuccaaucgccugcucgcccccagcgacucuccugaguggcuguccuuugaugugacaggggucgugagacaauggcugagccggggaggcgagaucgaaggcuuccgccucucugcucauuguuccugcgacagcagagauaacacccuucagguggacaucaauggguuuacgaccggacggagaggcgaucuggccacaauucacgggaugaaccgccccuuccugcuccugauggcuacaccccuugagcgggcccagcaucugcaguccucuagacaccgccgggcgcucgacaccaauuacuguuuuagcuccaccgagaaaaacugcugugucagacaacuguacaucgauuuccgcaaggaccugggauggaaauggauucacgaaccuaagggcuaucaugccaauuuuugccucgggccgugucccuacaucuggagccuggauacgcaguauucuaagguucuugcucuguacaaccagcacaauccuggagccuccgcugcccccugcugugugccucaggcccucgaaccccugccgauuguguauuacgucggccggaaaccuaagguggagcaacugagcaacaugaucguuagaucuugcaaauguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4355 - RNA, 1592 nt, Artificial Sequence
  mRNA product Design3 comprising derived and/or modified sequence from Homo sapiens__NP_003229.1__HsTGFB2 (opt5)
gggagagucccgcagucggcguccagcggcucugcuuguucgugugugugucguugcaggccuuauucaagcuuaccaugcacuacugcgugcugagcgccuuccucauccugcaucuugucaccguugcucugucccucucuacauguagcacgcuggacauggaucaguuuaugagaaagcggauugaggccauccgcggccaaauucuuuccaaacugaagcucaccucucccccugaagacuauccggagcccgaagaggugccucccgaagugaucagcauuuacaacuccacaagagaucugcugcaggagaaagcgucucggcgcgcugccgccugcgagagagaacggagcgacgaggaauauuacgcuaaggaggucuauaaaaucgauaugccucccuucuuuccuuccgagaaugccaucccgcccaccuucuaccgcccuuauuuuagaauugugcgguucgacguuagcgcuauggaaaagaacgccucuaaucucgugaaggcggaguuucgcgucuucagacugcagaaccccaaagcccgggugccugaacagcgcaucgagcuuuaccaaauucugaaguccaaagaucucacaagccccacccagagauacaucgacucuaagguugugaaaacacgggcugaaggggaguggcuguccuuugaugucaccgacgccgugcacgaguggcuucaucacaaggaucgcaaucugggauucaagauuagccuccauuguccgugcuguacguuugugccuucuaacaauuauaucauucccaacaaauccgaggaacuggaagcuagauucgccggcaucgacgggaccagcacauacaccuccggagaucagaagacaaucaaaucuacccggaagaaaaauagcggcaagacgccucaucugcuccugaugcuucugcccuccuauagacucgagagccagcaaacaaaccgccggaaaaagagagcgcuggacgccgcuuacugcuuucgcaauguccaggacaacuguugccuucggccccuguauauugauuucaagagagaccucggguggaaauggauccacgaaccuaagggauacaaugccaacuucugugcuggcgccugcccguaucuguggucuuccgauacccagcacagccgcguucugucucucuacaauacaauuaaccccgaggccagcgcuuccccuuguugcgugucucaggaccuggagccccuuaccauccuguacuauauuggcaaaaccccuaagaucgaacaacucagcaacaugaucgugaaauccugcaaguguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4356 - RNA, 1586 nt, Artificial Sequence
  mRNA product Design3 comprising derived and/or modified sequence from Homo sapiens__NP_003230.1__HsTGFB3 (opt5)
gggagagucccgcagucggcguccagcggcucugcuuguucgugugugugucguugcaggccuuauucaagcuuaccaugaagaugcaccuucagagagcccucgugguccuggcucugcugaacuucgccaccguuagccucucccugucuacaugcacgacccuugacuuuggccauaucaaaaagaaacggguggaggcgauucgcgggcaaauccugagcaagcucagacugacaucucccccugaaccgaccgugaugacacacguccccuaccaggugcuggcucucuauaauuccacccgggagcugcuugaagagaugcauggagaacgcgaggagggcuguacacaggaaaacaccgagagcgaauacuaugccaaagagauucacaaguucgauaugauccaggggcuggccgagcauaaugaacucgcuguuugcccuaagggaauuacguccaaaguguuuagauucaacgucucuagcguggagaagaaucggaccaaccuguuucgcgccgaguucagaguucuucgggugcccaauccuuccagcaaacgcaacgaacaaagaaucgaacuguuucagauccuccggcccgacgagcacauugcuaagcagcgcuacaucggcgggaaaaaucugccuacaagaggaaccgccgaguggcugucuuucgaugucacagacaccgugcgggaauggcuccugcgcagagaguccaaccuuggccuggaaauuagcauccacuguccgugccauacguuucagcccaauggcgauauucucgagaacauccacgaagugauggagauuaaguucaagggggucgacaaugaggaugaccauggacggggcgaucuggggagacuuaaaaagcaaaaagaccaccacaacccucaucugauccucaugaugauucccccucaccgccuggauaaucccggacagggcgggcagcggaagaaaagagcgcuggacacaaacuauuguuuucgcaaccucgaagagaauugcuguguucggccgcuguacaucgauuucagacaggaccuuggauggaagugggugcaugaaccuaaaggcuauuacgccaacuuuugcucuggccccuguccuuaccugcgcuccgcugacaccacacacagcaccgugcucgggcuguauaauacccuuaaccccgaggccucugcuucccccugcugugucccucaagaucuggaaccgcucacaauccuguacuaugugggacggacgcccaagguugagcagcugagcaauaugguggucaaguccugcaaaugcucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4357 - RNA, 1733 nt, Artificial Sequence
  mRNA product Design3 comprising derived and/or modified sequence from Homo sapiens__NP_001057.1__HsTNFRSF1B (opt5)
gggagagucccgcagucggcguccagcggcucugcuuguucgugugugugucguugcaggccuuauucaagcuuaccauggcccccguggcugucugggccgcgcuggcuguuggccucgagcugugggccgccgcucacgcccuuccugcucagguggccuucaccccguacgcgcccgaaccugggagcacaugcagacugcgggaguauuacgaccaaacggcccagauguguugcuccaaguguucucccggacagcaugcuaaaguguuuugcaccaagacaagcgauaccgucugugacuccugcgaagauucuacauauacccagcucuggaacugggugccugagugucugagcugcggcucccgcuguucuagcgaccaaguugaaacacaggccugcaccagagagcagaaucggaucuguacgugccgccccgggugguacugcgcucuuuccaaacaggagggauguagacugugcgccccucuccggaagugucgcccgggcuucgggguggcgagacccggaaccgaaacaagcgaugucgugugcaaaccuugugcccccggcaccuuuucuaacacaaccuccagcacggacauuugccggccucaccaaaucuguaauguuguggcuauucccggcaacgccucuauggaugcugucugcacauccaccagcccgacacgcucuauggccccuggggccgugcaucugccccagccuguguccaccagaagccagcacacccagcccacacccgagccuuccacggcuccgucuaccagcuuccugcuccccaugggaccuuccccucccgcggaaggcagcacaggggacuuugcccugcccgucggacuuaucguuggcgugaccgcucuggggcuccugauuaucggaguggucaauugugugaucaugacacaaguuaagaagaaaccgcuuugccugcagcgggaggccaaggugccucaucuccccgccgauaaagcucgcggcacccagggcccugagcaacagcaucugcugauuacggcccccucuuccagcucuagcucccucgaaucuagcgcguccgcucuggacagacgggccccuacacgcaaccagccccaggccccgggggucgaggcuagcggagccggcgaagcuagagccucuaccggguccagcgauucuuccccuggaggccacgggacccaagugaauguuacauguaucgugaacgucugcagcuccucugaccacagcucccagugcucuagccaggcguccagcaccaugggagauacagacucuucccccagcgagucucccaaggacgaacaggugccuuucuccaaagaggagugugccuuucggagccaacuugaaacgccggagacccugcucggcucuacagaagagaagccccugccucuuggcguccccgaugcugggaugaagccuagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4358 - RNA, 860 nt, Artificial Sequence
  mRNA product Design3 comprising derived and/or modified sequence from Homo sapiens__NP_002623.2__HsPGF (opt5)
gggagagucccgcagucggcguccagcggcucugcuuguucgugugugugucguugcaggccuuauucaagcuuaccaugcccgugaugagacuguucccuugcuuucuccagcugcuugccggccuggcucucccggccguucccccucaacagugggcgcugagcgcugggaacggauccucugaggucgaaguggugcccuuccaggaggucuggggccggagcuacugucgcgcccuugaaagacugguggacguuguguccgaguauccuucugaagucgagcacauguuuagccccuccugcgugucucuccugcgguguaccgggugcuguggagaugagaaucugcauugcguuccuguggaaacagccaacgucacgaugcagcuccugaagauccgcagcggcgacagaccguccuacguggagcuuaccuucagccaacacgugcggugugaaugccgcccccugagagagaaaaugaagccugagcggcgcagacccaaagggcggggaaagcgcagacgggaaaaacagcgcccuacagauugucaucucugcggcgacgcuguccccagacggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4359 - RNA, 1586 nt, Artificial Sequence
  mRNA product Design3 comprising derived and/or modified sequence from Homo sapiens__NP_001020537.2__HsVEGFA (opt5)
gggagagucccgcagucggcguccagcggcucugcuuguucgugugugugucguugcaggccuuauucaagcuuaccaugaccgacagacagacagauacggcccccagcccuuccuaccaccuucucccgggccggcgcagaaccguggacgcugccgcgucucgggggcaaggacccgagccugcucccggcgggggagucgaaggcguuggggcccgcggaguggcccugaagcuguucgugcagcugcucggcugcagcagauuuggcggggcugucgugcgggccggagaggcugaaccuuccggcgccgcgcgcucugccagcuccgggagagaggaaccccagccugaggagggagaagaggaagaggagaaagaagaggaacggggcccgcaguggcgccugggggcuagaaagcccggaucuuggacaggcgaggccgcuguuugugccgauagcgcgccugccgcucgggcuccccaagcccuugcccgcgccuccggcagagggggacggguggcucgcagaggcgcggaagagagcgggccuccccauucuccgucccggagaggaagcgccucucgcgcuggcccugggcgggccuccgagaccaugaacuuccugcucagcuggguccacuggucucuggcccugcuccuguaucuucaucacgcuaaauggucccaggccgcgcccauggcugaaggaggcggccagaaucaucacgaggugguuaaguuuauggacguguaccagagaagcuauugccacccuaucgaaacacuggucgauauuuuccaagaguaccccgacgaaaucgaguauauuuuuaaacccuccugugugccucucaugcgcugcgggggauguugcaacgaugagggccuggaaugugugccgaccgaggaaucuaauaucacaaugcagauuaugcggaucaagccccaucaggggcagcacaucggagagaugagcuuccuucaacauaacaagugcgaauguagaccuaaaaaggaccgcgcccggcaggagaaaaaguccgucagaggcaaagggaagggccagaagcgcaaacggaagaaaagcagauacaagucuugguccguuuaugugggagcccgcugcugucugaugcccuggagccucccuggcccccacccgugcgggccuugcucugagcggagaaaacaccuguuugugcaagauccccagaccuguaagugcagcuguaaaaauacggacucccggugcaaggcucgccagcuggaacucaacgagagaaccugucggugcgauaagccuagacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4360 - RNA, 1046 nt, Artificial Sequence
  mRNA product Design3 comprising derived and/or modified sequence from Homo sapiens__NP_001165094.1__HsVEGFA (opt5)
gggagagucccgcagucggcguccagcggcucugcuuguucgugugugugucguugcaggccuuauucaagcuuaccaugaacuuccugcucagcugggugcacuggucccuggcccuucugcucuaccugcaucacgcuaaguggucucaggccgcgcccauggcugagggcgggggacaaaaucaucacgaagucguuaaauuuauggacguguaucagagaagcuacugccauccuaucgagacccuuguggauauuuuccaggaauauccggacgagaucgaauacauuuuuaagcccuccugugucccucugaugcggugcggcggguguugcaacgaugagggacucgagugugugcccacagaagagucuaauaucacgaugcagauuaugcgcaucaaaccucaccaaggccagcacaucggggaaaugagcuuccugcagcauaacaagugcgaguguagacccaaaaaggaccgggcccgccaggagaagaaauccguuagaggaaagggcaaaggccaaaagcggaaacgcaagaagucuagauauaaaagcugguccguguacgucggggcccggugcugucugaugccuuggagccucccgggaccccacccuugcggccccuguucugaacgcagaaagcaucuguuugugcaggauccucagaccugcaaaugcuccuguaagaauacagacagccggugcaaagcucgccagcuugagcugaacgaaagaaccugucggugcgauaagccccgcagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4361 - RNA, 971 nt, Artificial Sequence
  mRNA product Design3 comprising derived and/or modified sequence from Homo sapiens__NP_003368.1__HsVEGFB (opt5)
gggagagucccgcagucggcguccagcggcucugcuuguucgugugugugucguugcaggccuuauucaagcuuaccaugagcccccugcucagacggcugcuucuggccgcucuccugcagcuugccccugcgcaagcuccggugucccagcccgacgccccuggccaccagcgcaaggucguuucuuggaucgauguguacaccagagccacaugccagccccgggagguggucgugccucugacgguugaacucauggggaccguggcuaagcaacugguccccagcugugugacaguucagcgcugcggaggcuguugcccugacgaugggcuggagugugugccgaccggacagcaucaggucagaaugcaaauucucaugauccgguaucccuccucucagcugggcgaaaugagccuugaggaacacucccagugcgagugucgcccuaagaaaaaggacucugccgugaaacccgauagagcugccacaccucaucaccggccccagccgcgcagcgugccugggugggacuccgcgcccggagccccuagccccgcugauauuacccaucccaccccugccccgggccccucugcucacgccgcgccuuccacaacgagcgcccugacccccggcccugcugccgcugccgccgacgcugcggccucuuccgucgcuaaagggggagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4362 - RNA, 1607 nt, Artificial Sequence
  mRNA product Design3 comprising derived and/or modified sequence from Homo sapiens__NP_005420.1__HsVEGFC (opt5)
gggagagucccgcagucggcguccagcggcucugcuuguucgugugugugucguugcaggccuuauucaagcuuaccaugcaucugcucggcuucuuuagcguggccugcucccugcuugcugccgcgcugcuccccgggccuagagaggcuccggccgccgcugccgcuuucgaaucuggacuggaccuuagcgaugccgagcccgacgcgggcgaagccaccgcuuacgccuccaaggaucuggaggaacagcuccggucugucagcuccguugacgagcugaugacagugcuguauccugaguacuggaaaauguauaagugucaacuccgcaaagggggauggcagcacaacagagaacaggcuaaucugaacucucggacggaggaaaccaucaaguuugccgcggcccacuacaauacagagauucuuaaaagcaucgauaacgaguggcgcaagacccagugcaugcccagagaaguguguauugacgucggcaaggaguucgggguggcuacaaauaccuuuuucaaaccucccugcguuuccguguaucgguguggaggcugcuguaacagcgaaggccugcaaugcaugaauacaucuaccuccuaccucagcaagacgcuguuugagaucaccgucccucuuucucaggggccgaaacccgugacaauuuccuucgccaaccauaccagcugucgcugcaugucuaagcuggauguuuauagacaggugcacuccaucauccggcgcagccucccugcuacacugccccagugucaagccgccaauaaaaccugcccuacgaacuacauguggaauaaccauauuugcagaugucuggcucaggaagacuuuauguucuccucugaugcgggagacgauagcacagacggcuuucacgauaucugcgggcccaauaaggagcucgacgaggaaaccugucagugcgucugucgggccggacugcgcccggcuuccugcggcccucacaaggagcuugacagaaacagcugucagugcguguguaaaaauaagcuguuccccucucaaugcggggccaaccgggaauuugaugagaacacaugucagugcgugugcaaacgcaccuguccuagaaaucagccccucaaccccggaaagugcgccugugaaugcaccgaguccccucaaaaaugucugcuuaagggcaaaaaguuccaucaccagacaugcagcuguuaccggagaccgugcacgaaucgccagaaggcuugugagcccggcuucucuuauagcgaagaggucugccgguguguuccuuccuacuggaaaagaccccagaugucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4363 - RNA, 1412 nt, Artificial Sequence
  mRNA product Design3 comprising derived and/or modified sequence from Homo sapiens__NP_004460.1__HsVEGFD (opt5)
gggagagucccgcagucggcguccagcggcucugcuuguucgugugugugucguugcaggccuuauucaagcuuaccauguacagagaguggguggucguuaacguguucaugaugcuguaugugcagcucguccaaggcagcuccaaugaacacgggcccgugaagcggucuagccaguccacccuggagcgcucugaacagcagaucagagccgcuagcucccuugaggaacugcuccggauuacacauucugaggacuggaaacuguggcgcugcagacuucggcucaagagcuuuacguccauggauagccgcucugccucccacagaagcacccgguucgcggcuacauuuuacgacaucgagacccugaaaguuauugaugaagaguggcaacgcacacaguguucuccuagagaaaccugcguggaggucgccuccgagcugggaaagagcacaaacaccuucuuuaaaccgcccugugugaauguuuuccggugcggcggguguugcaacgaagagucucugaucuguaugaauacguccaccagcuauauuuccaagcagcucuuugaaaucucugugccucugacaagcguccccgagcuugugccugugaaggucgccaaccauaccggaugcaaaugucugcccacagcuccucgccacccguacuccaucauuagacggagcauccagauucccgaagaggaccgcugcucucauuccaagaaacucuguccuaucgauaugcugugggacagcaauaagugcaaaugcguucuucaagaggaaaacccccuggccggcaccgaggaucacucucaccuccaggaaccugcucugugugggccccauaugauguucgacgaggauagaugcgaaugugugugcaagacgccguguccuaaggaccugauucagcaccccaaaaauugcagcuguuuugagugcaaggagucccucgaaacauguugccagaaacauaagcuguuccacccugauaccuguucuugcgaggaccggugccccuuucacacaagacccugugccagcggaaaaaccgcgugcgccaagcauugucgcuucccuaaagaaaagcgggcugcccaaggcccgcacuccagaaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4364 - RNA, 977 nt, Artificial Sequence
  mRNA product Design3 comprising derived and/or modified sequence from Homo sapiens__NP_061986.1__HsFGF21 (opt6)
gggagagucccgcagucggcguccagcggcucugcuuguucgugugugugucguugcaggccuuauucaagcuuaccauggacucagacgaaacaggauuugaacacucaggauuauggguaucaguauuagcaggauuacuacucggagcaugccaagcacacccaaucccagacucaucaccauuauuacaauucggaggacaagucagacaacgauacuuauacacagacgacgcacaacaaacagaagcacauuuagaaauaagagaagacggaacaguaggcggagcagcagaucaaucaccagaaucacuacuacaacuaaaagcacuaaaaccaggaguaauacaaauauuaggaguaaaaacaucaagauucuuaugccaaagaccagacggagcacuauacggaucauuacacuuugauccagaagcaugcucuuucagagaacuacuacuagaagacggauacaacguauaccaaucagaagcucauggacuaccuuuacaccuaccaggaaacaaaucaccacacagagauccagcucccagaggacccgcaagauuccuaccauuaccaggauuaccaccagcauuaccagaaccaccaggaauacuagcaccacaaccaccagacguaggaucaucagacccauuaucaaugguaggaccaucacaaggaagaucaccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4365 - RNA, 1757 nt, Artificial Sequence
  mRNA product Design3 comprising derived and/or modified sequence from Homo sapiens__NP_002412.1__HsMMP1 (opt6)
gggagagucccgcagucggcguccagcggcucugcuuguucgugugugugucguugcaggccuuauucaagcuuaccaugcacucauuuccaccacuauuauuacuacuauuuuggggagucguaucacauagcuuucccgcaacacuagaaacccaagaacaagacguagacuuaguacaaaaauaucuagaaaaauacuauaaccucaaaaacgacggaagacaagucgaaaaaagaagaaacagcggaccaguuguagaaaaacuaaaacaaaugcaagaauuuuucggauuaaaaguuacuggaaaaccagacgcagaaacacuaaaaguaaugaaacaaccaagaugcggaguaccagauguagcacaguucguauuaacagaaggaaacccacguugggaacaaacacaucuuacauacagaauugaaaauuacacaccugaccuaccaagagcagacguagaccacgcaauagaaaaagccuuucaauuauggucaaacguaacaccauuaacauucacaaaaguuucugaagggcaagcagacauaaugaucucauuuguuagaggagaccaccgagacaauagcccauucgacgggccaggaggaaaccuagcacaugcuuuccaaccaggaccuggaauaggaggcgacgcacauuucgacgaagacgaacgauggacaaacaauuucagagaauacaaccuacauagaguagcagcccacgaauuaggccacagccuaggcuuaucacacucaacagacauuggagcucuaauguacccuuccuacacauuuucaggagacguacaauuagcccaagacgauauagacggaauacaagcaauauacggacgaucacaaaacccaguacaaccaauaggaccacaaacaccaaaagcaugcgacucaaaauuaacauuugacgccauaacaacaauaagaggagaaguaauguuuuucaaagaccgauuuuauaugagaacaaauccauucuacccagaaguagaauuaaacuuuauaaguguauucuggccucaauuaccaaacggauuagaagcagcauaugaauuugcagacagagacgaaguacgauucuuuaaaggaaauaaauacugggccguacaaggacaaaacguauuacauggauacccaaaagacauauacagcucauucggguuuccaagaacaguaaaacacauagacgccgcauuaucagaagaaaacacaggcaaaacauauuuuuucguagcaaacaaauacuggagauacgacgaauacaaaagaucaauggacccaggauauccaaaaaugauagcacacgauuucccuggcauugggcacaaaguagaugcaguauucaugaaagauggcuuuuucuacuucuuucacggaacucgacaauacaaauucgacccaaaaacaaaaagaauacucacacuacaaaaagcaaacaguugguucaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4366 - RNA, 1517 nt, Artificial Sequence
  mRNA product Design3 comprising derived and/or modified sequence from Homo sapiens__NP_002412.1__HsMMP1(1-19,100-469) (opt6)
gggagagucccgcagucggcguccagcggcucugcuuguucgugugugugucguugcaggccuuauucaagcuuaccaugcauucauucccaccacuacuauuauuauuauucuggggaguaguaucacauucauuuguacuaacugaaggaaauccuagaugggaacaaacucacuuaaccuauagaauagaaaacuauacaccagaccuaccaagagccgacgucgaccacgcaauugaaaaagcauuccaauuauggaguaacguaacaccacuaacauucacaaaaguaucagaaggacaagcagacauaaugauaucauuugucagaggagaccaccgagacaacucaccauuugacggaccuggaggaaaucucgcacacgcauuccaaccaggaccaggaauaggaggagacgcacauuuugaugaagaugaacgauggaccaacaauuuuagagaauacaaccuacaccgaguagccgcacacgaacucggacacagccuaggacuaucacacucaaccgacaucggagcacuaauguacccaucauacacauucuccggagacguccaacuagcucaagacgacauagacggaauacaagcaauauacggaagaucacaaaauccuguacaaccaauaggaccacaaaccccaaaagcaugcgacucaaaauuaacauuugacgcaauaaccacaauuagaggugaaguaauguuuuucaaagauagauuuuacaugagaacaaaucccuucuauccagaaguagaauuaaauuucauaucaguauucuggccacaacuaccaaauggauuagaagcagcauacgaauuugcagauagagacgaaguaagauucuucaaaggcaacaaauacugggcaguacaaggccaaaacguacuacacggauauccuaaagacauauacucuuccuuuggauuuccuagaacaguaaaacacauagaugccgcacuaucagaagaaaacaccggaaaaacauacuucuucgucgccaauaaauacuggagauacgacgaauauaaacgaucaauggacccagguuacccaaaaaugauagcacacgauuucccaggaauaggacacaaaguugacgcagucuuuaugaaagacggauuuuucuacuucuuucacggaacacgacaauacaaauucgaucccaaaacuaaaagaauccuaacuuuacaaaaagccaauucuugguuuaauuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4367 - RNA, 3704 nt, Artificial Sequence
  mRNA product Design3 comprising derived and/or modified sequence from Clostridium histolyticum__BAA77453.1__ColG (opt6)
gggagagucccgcagucggcguccagcggcucugcuuguucgugugugugucguugcaggccuuauucaagcuuaccaugaaaaaaaacauacucaaaauucuaauggacucauacucgaaagaaucaaaaauacaaacaguccgcagaguuacaucagucucguuacuagcaguauaccugacgaugaacacauccucguuaguacucgcuaaaccuauagaaaauaccaacgauaccaguauaaaaaacguagaaaaauuaagaaaugcaccaaacgaagaaaacaguaaaaaaguagaagacaguaaaaaugacaaaguagaacauguaaaaaacauagaagaagcaaaaguugaacaaguagcaccagagguaaaauccaaaagcacauuaagaagcgcgucaaucgccaacacaaauucagagaaguacgacuucgaauacuuaaacggauuaaguuauacagaacuaacaaaucucauuaaaaauaucaaauggaaccagauaaauggacuauuuaauuacucaacaggaucacaaaaauuuuucggagacaaaaauagaguacaagcaauuauaaacgcuuuacaagaaagcggacgaacguauacagcaaacgauaugaaaggaauugaaacauucacagaaguacuacgcgcugguuuuuaucugggcuauuauaacgacggacuaucauaccucaacgaccgaaacuuccaagauaaaugcauaccagcgaugauugcaauucaaaaaaacccaaacuuuaaacuaggaaccgcaguccaagaugaaguaauaacgucgcucggaaaacuaauaggaaaugcaagcgcuaaugcagaaguuguaaauaacuguguucccguacuaaaacaauuccgagaaaauuuaaaucaauacgcaccagauuacgucaaaggaacggccguuaaugaacuuaucaaaggaauagaauuugauuucucaggagcagcuuaugaaaaagacguaaagacuaugccaugguacggaaaaauagaucccuuuauaaaugagcugaaggcacuaggccuuuacggaaacaucacaucagcuacagaaugggcgucagaugucgggauauacuaucuaucaaaauucggacuuuacucaaccaaccgaaaugauauaguacaauccuuagaaaaagcaguagauauguauaaauacggaaaaauagcuuucgucgcaauggaacgaaucacaugggauuaugacgguauaggaagcaauggaaaaaaaguagaucaugacaaauuccuagaugacgcagaaaaacauuaccuccccaaaacauacaccuucgauaacggcacauucauaauaagagcuggagacaaaguaucagaagaaaaaaucaaacguuuauacugggcaucacgagagguuaaaucacaauuccauagaguagucgguaaugacaaagcauuagaaguaggcaaugcagacgacguacucacaaugaaaauauucaauucuccugaagaauauaaauuuaauaccaacauuaacggaguaucuacagacaauggaggccuuuacauagaaccaagaggaacguucuauaccuacgaaagaacaccacaacaaucaaucuuuucauuagaagaacuauuuagacacgaauacacacacuaucugcaagcacgauaccugguggauggacuauggggacaagggccauuuuaugaaaaaaaccgcuuaacaugguuugaugaaggcacagccgaauuuuucgcaggaucaaccagaacaucgggugucuuaccacggaaaucaauacucggguacuuagcaaaagacaaaguagaucauagauauucauuaaaaaaaacacuaaauaguggauaugaugacucggauuggauguuuuacaacuaugguuuugcgguagcacauuauuuauaugaaaaagauaugcccacauucauaaaaaugaacaaagcuauauuaaauaccgauguaaagagcuaugaugaaauaauaaaaaaacucagugaugaugcaaauaaaaacacugaauaucaaaaccacauacaagaacuagcagacaaauaccaaggagcagguauuccguuaguuucagaugauuacuuaaaagaccacggauauaaaaaagcaucagaaguauacagugaaauaucgaaagcagccagccuuacaaacaccucaguaacagcagagaaaagucaauauuucaacacauuuacacuaagaggaacauacacgggggaaaccucaaaaggagaauuuaaagauugggaugaaauguccaaaaaacuagacggaacacuagagagcuuagcuaaaaacaguuggagcggauacaaaacuuuaacggcauacuuuacuaacuaccgaguuacaagugacaauaagguucaauacgacguaguauuucacggaguacuaacagacaacgcugauauuaguaacaacaaagcgccuaucgcuaaaguaacaggaccaucgacuggggcagucggaaggaacauagaauuuucugggaaagacaguaaagaugaagacggaaaaauaguuaguuacgauugggauuuuggcgauggagcuaccucucguggaaagaacucugugcaugcauacaaaaaagcaggaacauauaacguaacccuaaaaguaacagacgacaaaggagcaacagcuacagagagcuuuaccauagaaauaaaaaacgaagauacaacgacaccaauaacaaaagagauggaaccuaaugaugacauaaaagaagcuaacggacccauaguggaaggaguaacagugaaaggagaccugaauggcagcgaugacgcugauacuuuuuauuucgaugucaaagaagacggugacguaaccauugaacuaccguacagcggcaguucaaauuuuacaugguugguauauaaagaaggagacgaccaaaaccacauagcaucuggaauagauaaaaauaacucaaaaguugguacauuuaaaaguacaaaagguagacacuauguauucaucuauaaacacgacagcgcaucaaacauauccuauucccucaauauaaagggacuaggaaaugaaaaacugaaagaaaaagaaaauaacgauuccagugacaaagcaacuguaaucccaaauuuuaauacaacaaugcaaggaucuuuauuaggagacgauagucgcgacuauuacucauuugaagugaaagaagaaggagaaguaaauauagaacuugacaaaaaagacgaguucggaguaaccuggacucuccacccagaaucaaauauaaacgauagaaucacauacggacaaguagacgguaacaaagucucaaauaagguaaaacuuagaccagggaaauacuauuuacucguauauaaauacucuggcagcggcaacuacgaguuacggguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4368 - RNA, 3428 nt, Artificial Sequence
  mRNA product Design3 comprising derived and/or modified sequence from Clostridium histolyticum__BAA77453.1__HsALB(1-18)_ColG(111-1118) (opt6)
gggagagucccgcagucggcguccagcggcucugcuuguucgugugugugucguugcaggccuuauucaagcuuaccaugaaaugggucaccuuuauaagucuacuuuucuuauuuuccucagcauauagcauagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4369 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt6)
gggagagucccgcagucggcguccagcggcucugcuuguucgugugugugucguugcaggccuuauucaagcuuaccaugaaguggguaacuuucauaagucuucuuuuccuuuucucuucagcauacucgaugaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4370 - RNA, 3452 nt, Artificial Sequence
  mRNA product Design3 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaacuuucucaaaauaauacugaaccguggcaaaacaaugaaaagaaaaugccuaaguaaaagacucaugcuggccaucacaauggcuacaauauucaccgucaacagcaccuuaccuauuuaugcagccguagacaaaaauaacgcuacugccgccguacaaaaugaaagcaaaagauacacugucucguaucuuaaaacacuaaauuacuacgaccuaguagauuuauuaguaaaaacagaaauagaaaaccuaccugaucucuuucaauacucaucagaugccaaagaauuuuacggaaacaaaacacgaaugucuuuuauaauggaugaaauaggccgcagagcuccacaauacaccgaaaucgaccacaaaggaauaccaacauuaguggaagugguaagagcaggauuuuauuuaggcuuccacaacaaagaacuaaacgaaauaaauaaaagauccuucaaggaaaggguaauacccucaauauuagcaauacagaaaaaccccaauuucaaacuaggaacagaagugcaagacaaaaucgucagcgcaacgggacuucuagccgguaacgaaacugcuccaccagaaguaguaaacaacuucaccccaauccuacaagacuguauuaaaaacauagacagauaugcauuagacgaucuaaagucaaaggcuuuauuuaacgucuuagcugcaccuacuuacgacauaacagaauaccucagggcaacaaaagaaaaaccggaaaauacaccuugguacggaaaaauagauggcuucauaaacgaacuaaagaaauuagccuuauacggaaaaauuaacgauaauaacucuuggauaauagauaaugguauuuaccacauagcuccguuagggaaacugcauaguaacaauaaaaucggaauagaaacauuaaccgaagucaugaaaguauacccauauuuaucaaugcaacacuuacaauccgccgaccaaaucaaaagacacuacgacagcaaagaugcagaaggaaauaaaauaccauuagauaaauucaagaaagaaggaaaagaaaaauacugcccaaaaaccuauacuuucgacgauggaaaaguaauaauaaaagcuggagcaagagucgaagaagaaaaaguaaaacgacucuacugggcaucaaaagaagucaacucacaauucuucagagucuauggcauagauaaaccgcuagaagagggaaaccccgaugacauccuaacaaugguaauauacaauucaccagaagaguauaaacuaaauagcguauuauacggauacgacacaaauaacggcggaauguacaucgaaccugaaggaaccuucuucaccuaugagcgagaagcccaagaaaguacauacacccuggaagaacuauucagacaugaauacacacauuaccuacaaggacgauacgccgugccaggacaaugggggcgaacgaaauuauacgacaacgacagacucacaugguaugaagaagguggagcagaauuauucgcaggcaguacccguacaucagguauccuaccaagaaaaucuaucgucaguaacauacacaacacaacuaggaauaaucgauacaaauuaucagacacaguacauuccaaauacggggccuccuucgaauuuuacaacuacgcgugcauguuuauggauuauauguauaacaaagauauggguauucuaaacaaauuaaacgaccuagccaagaauaaugacguggacggauacgacaacuauauuagggaccuaucaucaaauuaugcauuaaacgacaaauaccaagaccacaugcaagagaggauagauaauuacgaaaaccuaacaguaccauuugucgcagacgauuauuuagugcgacaugcauacaaaaauccaaacgaaaucuacagugagauuucagagguagcaaaacucaaggaugcgaaauccgaagucaagaaaagucaauacuucaguacauucacgcuaagaggaucauauacaggaggagccucaaaaggaaaauuagaagaccaaaaagcaaugaauaaauucauagacgauucauuaaagaaacuagauaccuacaguuggaguggcuauaaaacacucacugcauauuucacaaauuacaaaguagacucaucuaauaggguaaccuacgauguaguauuccacggauaccucccaaaugaaggcgacagcaaaaacucucucccauacggaaaaauaaacgggacauacaaagguacugaaaaagagaaaaucaaauucagcagcgaaggauccuucgacccagacggaaaaauuguuaguuaugaaugggacuucggagauggaaacaaaaguaaugaagaaaacccagaacauuccuaugacaaagucgggacuuacaccguaaaauuaaaaguuacagaugauaaaggcgaauccaguguaucaacaacaacagccgaaaucaaagacuuaagcgaaaauaaacuuccaguaauauauaugcacguaccaaaaucuggagcacuuaaccaaaaaguaguauucuacgguaaagguacauacgauccagacggaucaauagcuggguaucaaugggacuuuggagacgguucagauuucucaucagaacaaaaucccucccacguauacacaaagaaaggugaauacacagugacacuaagagucauggauagcagcggccaaaugucagagaaaacaaugaaaaucaaaauaacugaucccguauauccaauaggcacagaaaaagaaccaaacaacagcaaagaaacagccagcggaccaauaguaccaggcauacccgucaguggaacuauagaaaauacauccgaccaagacuacuuuuacuucgauguaauaaccccuggagaaguaaaaauagacauaaacaaauuagguuaugggggcgcaacauggguaguguacgaugaaaauaauaacgcaguaaguuaugcuacagacgacggccaaaaucuauccggaaaauucaaagcagacaaaccaggcagauacuauauucaucuauauauguuuaacgguagcuacaugccuuacaggaucaacauagaaggaagcguagguagauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4371 - RNA, 3413 nt, Artificial Sequence
  mRNA product Design3 comprising derived and/or modified sequence from Clostridium histolyticum__BAA34542.1__ColH (opt6)
gggagagucccgcagucggcguccagcggcucugcuuguucgugugugugucguugcaggccuuauucaagcuuaccaugaaacguaaaugccuuucaaaacgucuaauguuggcaauuacuauggcaacaauauuuacaguuaauuccacacuaccaauauaugcagcuguagacaaaaacaaugccacagccgcaguacaaaaugaauccaaaagguacacugucaguuaucuaaaaacucuuaacuauuacgaccuaguugaccuauuaguaaaaacagaaauagaaaaccuaccagacuuauuccaauacucaucugaugcuaaagaauuuuacggaaauaaaacccgcaugaguuuuaucauggaugaaauaggaagacgagcgccucaauauacugaaaucgaucacaaaggaauaccgacgcuaguagaaguuguaagagccgguuuuuacuuaggcuuucacaacaaagaacuaaacgaaauaaauaaacgaucauuuaaagagagaguaauacccagcauccuugccauacaaaagaauccaaacuucaaauuaggaacagagguacaagacaaaauaguauccgccacaggccuauuagcaggaaaugagacagcacccccugagguagugaacaauuucacaccaauauuacaagauugcauuaaaaauauagauagauaugcucuagaugaucuaaaaucaaaagcacuauucaacguacuagcagcacccacauacgauauaacagaauacuuacgagcgaccaaagaaaaaccagaaaacacaccaugguacggaaaaauagacggcuuuauaaaugaguuaaagaaauuagcauuauaugguaaaauaaaugauaauaacagcuggauuauagacaacgggauauaucauauagcaccccuaggaaaacuacacucaaacaauaaaauaggaauagaaacauuaaccgaagucaugaaaguuuauccuuacuuauccaugcaacacuuacaaucagcagaucaaauaaaaagacauuaugauucaaaagacgcagaagguaacaaaauaccccuagacaaauuuaagaaagaaggaaaagaaaaauauugcccaaaaacauacacauuugacgacgggaaaguaaucauaaaagcaggagcgagagucgaagaagaaaaaguaaaaagacucuacugggcaucuaaagaaguaaacucccaauucuucaggguauauggaauagacaaaccauuagaagaaggaaaucccgaugacauuuugacaaugguaaucuauaauaguccggaagaauauaaacugaacagugucuuauacggauaugauaccaacaacgguggaauguauauagaaccagagggaaccuucuucaccuaugaaagggaagcccaagaaucaacauacacucucgaggaacuauuuaggcacgaauauacacacuauuuacaaggacgauacgcaguaccaggacaauggggcaggacaaaacuuuacgauaacgacagacuaacuugguaugaagaagguggcgccgaacuauucgccgguucaacucgcacaagcggaauauugccacgaaaaucaaucguaucuaacauacacaacacaacaagaaauaaccguuacaaacuaucagauacaguucacuccaaauacggagcaaguuuugaauuuuacaacuacgccuguauguuuauggacuacauguauaauaaagauaugggcauacuaaauaaacugaacgauuuagcuaaaaacaaugacguagacggcuacgacaacuacauaagagauuuaaguuccaacuaugcacuaaaugauaaauaucaagaucacaugcaagaaagaauagauaacuaugaaaauuuaacaguaccuuuuguggcagacgauuaccuuguucgacacgcauauaaaaaccccaaugagauauauucagaaauuucagaaguagcaaaauuaaaagaugcaaaaagcgaaguaaagaaaagccaauacuucuccacauuuacccuccgaggaucauacaccggcggagccuccaaaggaaaacuagaagaccaaaaagcuaugaacaaauucauagaugacucccuaaagaaauuagacacauauucaugguccggauacaaaacccuaacggcuuacuucacaaauuacaaagucgacuccucaaauaggguuacauacgacgucguauuucacggauaucuccccaaugagggagacaguaaaaauucccuaccauacgggaaaauaaacggaacauauaaagggacagaaaaagagaaaauaaaauucucgucugaaggaucuuuugaccccgacgggaaaauugugucauaugaaugggauuuuggagauggaaauaaaucaaaugaagaaaacccagaacacagcuaugacaaaguaggcacauacaccguaaaauuaaaaguaacagacgacaaaggagaaucaucaguauccaccaccacagcagaaauuaaagaucuaucugaaaacaaacucccaguaaucuauaugcacguaccuaaaaguggcgcucucaaucaaaaaguaguauuuuacggaaaaggaacauaugacccagacggaagcauagcaggguaucaaugggauuucggagauggaucugauuuuucuucagaacaaaacccaucgcacguauacaccaagaaaggagaauauacaguaacacuaagaguuauggauucaucuggacaaaugucugagaaaacuaugaaaauaaaaauaacagacccaguuuauccaauaggcacagaaaaagaaccaaacaacaguaaagaaacagcaucaggaccaaucgucccgggcauaccaguaaguggaacaauagaaaauacaagcgaccaagauuacuucuacuucgauguaauaacaccaggcgaaguuaaaauugacauaaacaaacucggauauggaggagcaacauggguaguauaugaugaaaacaauaaugccguaucuuacgccacagacgauggacaaaaccuaaguggaaaauuuaaagcugauaaacccggacgcuacuacauacaccuguauauguuuaacgguucauacaugccauacaggauaaacauagaagggagugugggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4372 - RNA, 3347 nt, Artificial Sequence
  mRNA product Design3 comprising derived and/or modified sequence from Clostridium histolyticum__BAA34542.1__HsALB(1-18)_ColH(41-1021) (opt6)
gggagagucccgcagucggcguccagcggcucugcuuguucgugugugugucguugcaggccuuauucaagcuuaccaugaaauggguuacuuuuauaucauuacuauuccuauucucaucagcauacagcguacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4373 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt6)
gggagagucccgcagucggcguccagcggcucugcuuguucgugugugugucguugcaggccuuauucaagcuuaccaugaaauggguuacauucaucagcuuacuauuccuauucaguagcgccuacagcaugaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4374 - RNA, 923 nt, Artificial Sequence
  mRNA product Design3 comprising derived and/or modified sequence from Homo sapiens__NP_001133.1__HsAMELX (opt6)
gggagagucccgcagucggcguccagcggcucugcuuguucgugugugugucguugcaggccuuauucaagcuuaccauggguaccuggauauuauucgcaugccuacuaggcgcagcauucgccaugccauuaccaccacacccaggacacccaggauacaucaacuucucauacgaaguacuaacaccacuaaaaugguaccaaucaauaagaccaccauacccaucauacggauacgaaccaauggguggauggcuacaccaccaaauaauaccaguacuaucacaacaacacccaccaacacacacacuacaaccacaccaucacauaccaguaguaccagcacaacaaccaguaauaccacaacaaccaaugaugccaguaccaggacaacacuccaugacaccaauacaacaucaccaaccaaaccuaccacccccagcacaacaaccauaccaaccacaaccaguacaaccacaaccacaccaaccaaugcaaccacaaccaccaguacaccccaugcaaccacucccaccacaaccaccacuaccaccaauguucccaaugcaacccuuaccaccaaugcuaccagaccuaacacuagaagcauggcccucaacagacaaaacaaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4375 - RNA, 482 nt, Artificial Sequence
  mRNA product Design3 comprising derived and/or modified sequence from Homo sapiens__NP_001133.1__HsAMELX-TRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaauaagaccaccauacccaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4376 - RNA, 515 nt, Artificial Sequence
  mRNA product Design3 comprising derived and/or modified sequence from Homo sapiens__NP_001133.1__HsAMELX-LRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4377 - RNA, 554 nt, Artificial Sequence
  mRNA product Design3 comprising derived and/or modified sequence from Homo sapiens__NP_001133.1__HLA-A2-SP_HsAMELX(17-60) (opt6)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccauacccaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4378 - RNA, 587 nt, Artificial Sequence
  mRNA product Design3 comprising derived and/or modified sequence from Homo sapiens__NP_001133.1__HLA-A2-SP_HsAMELX(17-47,168-191) (opt6)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4379 - RNA, 926 nt, Artificial Sequence
  mRNA product Design3 comprising derived and/or modified sequence from Homo sapiens__NP_001134.1__HsAMELY (opt6)
gggagagucccgcagucggcguccagcggcucugcuuguucgugugugugucguugcaggccuuauucaagcuuaccaugggaacauggauacuauucgcaugcuuaguaggagcagcauucgccaugccacuaccaccacaccccggccacccaggauacauaaacuucucauacgaaguauuaacaccacuaaaaugguaccaaucaaugauacgcccaccauacuccucauacggauacgaaccaaugggcggcugguuacaccaucaaauaauaccaguaguaucccaacaacacccacuaacacacacacuacaaucacaccaccacauaccaguaguaccagcacaacaaccacgaguacgccaacaagcacuaaugccaguaccaggacaacaaucaaugacaccaacacaacaccaccaaccaaaccuaccauuaccagcacaacaaccauuccaaccacaaccaguacaaccccaaccacaccaaccaaugcaaccacaaccaccaguacaaccaaugcaaccacuccuaccccaaccaccacuaccaccaauguucccacuaagaccacuaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4380 - RNA, 485 nt, Artificial Sequence
  mRNA product Design3 comprising derived and/or modified sequence from Homo sapiens__NP_001134.1__HsAMELY-TRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaaugauaagaccaccauacucaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4381 - RNA, 518 nt, Artificial Sequence
  mRNA product Design3 comprising derived and/or modified sequence from Homo sapiens__NP_001134.1__HsAMELY-LRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguauuaacaccacuaaaaugguaccaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4382 - RNA, 557 nt, Artificial Sequence
  mRNA product Design3 comprising derived and/or modified sequence from Homo sapiens__NP_001134.1__HLA-A2-SP_HsAMELY(17-61) (opt6)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaucaaugauaagaccaccauacagcucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4383 - RNA, 590 nt, Artificial Sequence
  mRNA product Design3 comprising derived and/or modified sequence from Homo sapiens__NP_001134.1__HLA-A2-SP_HsAMELY(17-48,169-192) (opt6)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4384 - RNA, 917 nt, Artificial Sequence
  mRNA product Design3 comprising derived and/or modified sequence from Sus scrofa__NP_999071.1__SsAMELX-001-1 (opt6)
gggagagucccgcagucggcguccagcggcucugcuuguucgugugugugucguugcaggccuuauucaagcuuaccaugggaaccuggauauuauucgcaugccuacuaggagccgcauucuccaugccacuaccaccacacccaggacacccaggauacauaaacuucucauacgaaguauuaaccccauuaaaaugguaucaaaacaugauaagacacccauacacaucauacggauacgaaccaaugggaggauggcuacaccaccaaauaauaccaguaguaucccaacaaacaccacaaucacacgcacuacaaccacaccaccauauaccaaugguaccagcacaacaaccaggaauaccacaacaaccaaugaugccacuaccaggacaacacucaaugacaccaacacaacaccaccaaccaaaccuaccacuaccagcccaacaaccauuccaaccacaaccaguacaaccacaaccacaccaaccacuacaaccccaauccccaaugcacccaauacaaccacuacuaccacaaccaccacuacccccaauguucucaaugcaaucacuacuaccagaccuaccacuagaagcauggccagccacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4385 - RNA, 485 nt, Artificial Sequence
  mRNA product Design3 comprising derived and/or modified sequence from Sus scrofa__NP_999071.1__SsAMELX-TRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaauaugauaagacacccauacacaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4386 - RNA, 518 nt, Artificial Sequence
  mRNA product Design3 comprising derived and/or modified sequence from Sus scrofa__NP_999071.1__SsAMELX-LRAP (opt6)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4387 - RNA, 557 nt, Artificial Sequence
  mRNA product Design3 comprising derived and/or modified sequence from Sus scrofa__NP_999071.1__HLA-A2-SP_SsAMEL(17-61) (opt6)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacauccaggacacccaggauauauaaauuucucauacgaaguauuaacaccacuaaaaugguaucaaaauaugauaagacauccauauacaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4388 - RNA, 590 nt, Artificial Sequence
  mRNA product Design3 comprising derived and/or modified sequence from Sus scrofa__NP_999071.1__HLA-A2-SP_SsAMEL(17-49,167-189) (opt6)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4389 - RNA, 881 nt, Artificial Sequence
  mRNA product Design3 comprising derived and/or modified sequence from Sus scrofa__P45561-2__SsAMELX-001-2 (opt6)
gggagagucccgcagucggcguccagcggcucugcuuguucgugugugugucguugcaggccuuauucaagcuuaccaugggaacauggauacuauucgcaugccuacucggugcagcauucucaaugccacuaccaccacacccaggacacccaggauacauaaacuucucauacauacgacacccauacacaucauacggauacgaaccaaugggaggauggcuacaccaccaaauaauacccguaguaucucaacaaacaccacaaucacacgcacuacaaccacaccaccacauaccaaugguaccagcacaacaaccaggaauaccacaacaaccaaugaugccauuaccaggacaacacucaaugacaccaacacaacaccaccaaccaaaccuaccacuaccagcacaacaaccuuuccaaccacaaccaguacaaccacaaccacaccaaccacuacaaccacaaucaccaaugcacccaauacaaccauuacuaccacaaccaccacuaccaccaauguucucaaugcaaucacuacuaccagaccuaccacuagaagcauggccagcaacagacaaaaccaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4390 - RNA, 917 nt, Artificial Sequence
  mRNA product Design3 comprising derived and/or modified sequence from Sus scrofa__NP_998965.1__SsAMELX-001-3 (opt6)
gggagagucccgcagucggcguccagcggcucugcuuguucgugugugugucguugcaggccuuauucaagcuuaccaugggaacauggauauucuucgccugccuacuaggcgcaucacuagcaaugccacuaccaccacacccaggacacccaggauauauaaacuucucauacgaaguacuaacaccucuaaaaugguaccaaaacaugauaagacauccauacacaucauacggauacgaaccaaugggcggaugguuacaccaccaaauaauaccaguagucucccaacaaacaccacaaucacacgcauuacaaccccaccaccacauacccaugguaccagcccaacaaccaggaauaccacaacaaccaaugaugccacuaccaggacaacacucaaugacaccaacacaacaccaccaaccaaaccucccauuaccagcacaacaacccuuccaaccacaacccguacaaccacaaccacaccaaccacuacaaccacaaucaccaaugcacccaauacaaccacuacuaccccaaccaccacuaccaccaauguucucaaugcaaucacuacuacccgaccuaccauuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4391 - RNA, 566 nt, Artificial Sequence
  mRNA product Design3 comprising derived and/or modified sequence from Sus scrofa__K7GPB2__SsAMELX-002 (opt6)
gggagagucccgcagucggcguccagcggcucugcuuguucgugugugugucguugcaggccuuauucaagcuuaccaugggaacauggauacuauucgcaugccuacuaggagcagcauucucaaugccacuaccaccacacccaggacacccaggauacauaaacuucucauacgaaguacuaacaccacuaaaaugguaucaaaacaugauaagacacccaucacuauuaccagaccuaccacuagaagcauggccagcaacagacaaaacaaaaagagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4392 - RNA, 959 nt, Artificial Sequence
  mRNA product Design3 comprising derived and/or modified sequence from Sus scrofa__K7GLD0__SsAMELX-003 (opt6)
gggagagucccgcagucggcguccagcggcucugcuuguucgugugugugucguugcaggccuuauucaagcuuaccaugggaacauggauacuauucgcaugccuacuaggagccgcauucucaaugccccuaccaccacacccaggacacccaggcuacauaaacuucucauacgaagaccuauaccuagaagcaauaagaauagacagaacagcauucguccuaacaccauuaaaaugguaccaaaacaugauaagacacccauacacaucauacggauacgaaccaaugggaggcuggcuacaccaccaaauaauacccguaguaucccaacaaacaccacaaucacacgcacuccaaccacaccaucacauaccuaugguaccagcacaacaacccggaauaccacaacaaccaaugaugccacuaccaggacaacacucaaugacaccuacacaacaccaccaaccaaaccuaccauuaccagcacaacaaccauuccaaccacaaccaguacaaccacaaccacaccaaccccuacaaccacaaucaccaaugcacccaauacaaccacuacucccacaaccaccccuaccacccauguucucaaugcaaucuuuacuaccagauuuaccauuagaagcauggccagcaacagacaaaacaaaaagagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4393 - RNA, 845 nt, Artificial Sequence
  mRNA product Design3 comprising derived and/or modified sequence from Sus scrofa__K7GPE9__SsAMELX-004 (opt6)
gggagagucccgcagucggcguccagcggcucugcuuguucgugugugugucguugcaggccuuauucaagcuuaccaugggcacauggauacuauucgcaugccuacuaggagcagcauucuccaugccacuaccaccacacccaggacacccaggauacauaaacuucucauacgaaguacucaccccacuaaaaugguaccaaaacaugauaagacacccaacaccacaaucccacgcacuccaaccacaccaccacauaccaaugguaccagcacaacaaccaggaauaccacaacaaccaaugaugccacuaccaggacaacacucaaugacaccaacacaacaccaccaacccaaccuaccacuaccagcacaacaaccauuucaaccacaaccaguacaaccacaaccacaccaaccacuacaaccacaaucaccaaugcacccaauacaaccacuacucccacaaccaccacuacccccaauguucucaaugcaaucacuauuaccagaccuaccacuagaagcauggccagcaacagacaaaacaaaacgagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4394 - RNA, 869 nt, Artificial Sequence
  mRNA product Design3 comprising derived and/or modified sequence from Sus scrofa__J9JIM4__SsAMELX-201 (opt6)
gggagagucccgcagucggcguccagcggcucugcuuguucgugugugugucguugcaggccuuauucaagcuuaccaugccacuaccaccacacccaggacacccaggauacauaaacuuuucauacgaaguacuaaccccacuaaaaugguaccaaaacaugauaagacaccccuacacaucauacggcuacgaaccaaugggaggauggcuacaccaccaaauaauaccaguaguaucacaacaaacaccacaaucacacgcacuccaaccacaccaccacauaccaaugguaccagcacaacaacccggaauaccacaacaaccaaugaugccacucccaggacaacacucaaugacaccaacacaacaccaccaaccaaaccuaccacuaccagcccaacaaccauuccaaccacaaccaguacaaccacaaccacaccaaccacuacaaccacaaucaccaaugcacccaauacaaccacuacuaccacaacccccacuacccccaauguucucaaugcaaucacuacuaccagaccuaccacuagaagcauggccagcaaccgacaaaacaaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4395 - RNA, 3308 nt, Artificial Sequence
  mRNA product Design3 comprising derived and/or modified sequence from Homo sapiens__NP_006120.1__HsBMP1 (opt6)
gggagagucccgcagucggcguccagcggcucugcuuguucgugugugugucguugcaggccuuauucaagcuuaccaugccagggguagcuagacuaccucuacucuuaggacuccuauuguuaccacggccaggaagaccguuagaucuagcggacuacacauaugaucucgcagaagaagacgacagugaaccgcuaaauuacaaagauccauguaaagcggccgcauuuuugggagauauagcauuagaugaagaagacuuaagagcauuucaaguacaacaagcuguugaucuaagaagacacacggcccgaaaaagcaguauaaaagcagcgguaccaggcaacacaagcacgccaucaugccaaaguacaaacggacaaccacaaagaggggcuugcgggagauggagaggaagaagcagaagcagacgcgcagcuacuucaagaccugaaagaguuuggccugacggcguaauaccauucguaauaggaggcaauuuuacaggaagucagcgcgcaguuuuucggcaagcaaugcgccacugggaaaaacauacuuguguaacauucuuagagcgaacagaugaagauuccuauauaguuuucacauacaggcccugcggauguuguucauauguaggaagacgcgggggaggaccacaagcgauaaguauaggaaaaaauugugacaaauucggaauaguuguccaugaauuaggucacguugugggauucuggcacgaacacacacgaccagauagagacagacauguaaguauaguaagggaaaauauacaaccagggcaggaauacaacuuuuuaaaaauggaaccccaagagguagaaucacuuggcgaaacuuacgauuucgauaguauaaugcauuaugcuagaaauacauuuucgagaggaauauuccuagacacuauaguaccgaaauacgaaguaaauggagugaaacccccaauaggccaaagaacuagacuaucaaaaggagacauagcacaggcaagaaaauuauauaaaugucccgcguguggugaaacauuacaagauucuacaggaaauuuuucaucuccugaauauccuaauggcuauagugcacacaugcauuguguauggcgcauuucaguaacaccaggagaaaaaauuauuuugaauuucacaagucuagacuuauacagaaguagauuauguugguaugacuauguagaagucagggauggauucuggagaaaagcuccucuaaggggaagauuuuguggaagcaaauuaccugaaccaauaguuagcacagauucaagacuuuggguagaauuuagaaguaguucaaauuggguaggaaaaggauuuuucgcaguguaugaagcaauuugcgguggagauguaaaaaaagacuaugggcacauacaaagcccaaacuauccugaugauuauagaccaucaaaaguauguauauggcgaauacaaguuagugaaggguuucacguaggauuaacuuuucaauccuucgaaauagaaagacaugacucuugcgcauaugauuauuuagaaguuagagacggacauagugagaguaguacucuaaucggaagauacugcggcuaugaaaaaccugaugacauuaaaagcacuagcucuagauuauggcuaaaauuuguaagugaugguagcauaaauaaggcagguuuugcaguaaacuuuuuuaaagagguugaugaauguucgaggccuaauagaggugguugugaacaacggugcuugaauacacuaggaagcuacaaaugcucaugcgauccaggcuacgaauuagcgccagauaaaagaagaugugaagcagcauguggaggauuuuugacuaaacuaaauggaucaauaacaaguccagguuggccgaaagaauacccuccuaauaaaaacuguauuuggcaacuuguagcaccuacucaauauagaauaucauugcaauucgauuuuuucgagacagaaggaaacgacguauguaaauaugacuuuguggaaguaagaaguggucuaaccgcugauaguaagcuacacggaaaauucugcgguagugagaaaccagaaguaauaacgucacaauacaauaauaugagaguugaauuuaagagugacaauacaguuucaaaaaaaggauuuaaagcacauuuuuucucagacaaagaugaguguaguaaagauaauggaggaugccagcaagacugcguaaauacauucggaagcuaugaaugucaaugucgauccggcuuuguauuacacgauaauaaacacgauuguaaagaagcuggaugcgaucacaaaguaacgaguacuagcggaacaauuacaagcccaaauuggccggacaaauaucccucaaaaaaagaauguacuugggcaauaucuucuacaccgggucauagagugaaauuaacauucauggaaauggacauagaaucacaaccagaaugugcauaugaucaccuugaaguauucgaugguagagaugcuaaagcuccaguacugggucgcuuuuguggaaguaaaaaacccgagccuguauuagcaacaggaucaagaauguuccuuagauucuacuccgacaauucaguacagagaaaagguuuccaagcuucucacgcaacagaauguggaggccaagugcgagcggauguaaaaacaaaagacuuauauucucacgcacaguuuggagacaauaauuauccaggagguguggauugugaauggguuauagucgcagaagaaggauacggaguagagcuagucuuucaaacauuugagguagaagaagaaacugauuguggauacgacuauauggaacucuuugauggauacgacucaacagcaccccgauuagguagauauuguggaucuggaccacccgaagaaguauauuccgcaggagacagcguauuagucaaguuccacuccgaugauaccaucacuaaaaaaggauuucaucuuagauauacaagcacaaaauuucaagacacucuucacagccgaaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4396 - RNA, 1538 nt, Artificial Sequence
  mRNA product Design3 comprising derived and/or modified sequence from Homo sapiens__NP_001191.1__HsBMP2 (opt6)
gggagagucccgcagucggcguccagcggcucugcuuguucgugugugugucguugcaggccuuauucaagcuuaccaugguagcugguacuagaugccuacuagcauuacucuuaccacaaguauuacuaggaggagcagcaggauuagucccagaacuagguagaagaaaauucgcagcugccucaucaggaagacccagcucacaaccuucagacgaaguccuaucagaauuugaauugagauuacuaucaauguucggacuuaaacaaagaccaacaccaucaagagaugcaguaguaccaccauauaugcuagauuuauauagaagacacucaggacaaccaggaaguccagcuccagaccauagauuagaaagagcagcaaguagagcaaacacagucaggagcuuucaucacgaagaaucacuagaagaauuaccagaaacaucaggaaaaaccacaagaagauuuuucuuuaaccuuaguucaauaccaacagaagaauucaucacaagugcagaacuacaagucuucagggaacaaaugcaggacgcacuaggaaauaauucaucauuccaucauagaauaaauaucuaugaaauaauaaaaccagcaacagccaacucaaaauucccaguaacaagacuacuagacacaagacuaguaaaccaaaacgcaagcagaugggaaagcuuugauguaacaccagcaguaaugcgauggacagcacaaggucacgcaaaucacggauucguagucgaagucgcgcaucuagaagaaaaacaagguguaagcaaacgacauguaagaauaaguagaaguuuacaccaagaugaacauucauggucacaaauaagaccacuccuaguaacauucggacaugacgguaaaggacacccacuacacaaacgagaaaaaagacaagcaaaacauaaacaaagaaaaagacuaaaaucaucaugcaaaagacauccguuauauguugacuuuucagauguaggauggaacgacuggaucguagcacccccaggauaucacgcauucuauugucauggagaauguccauuuccauuagcagaucacuuaaauagcacaaaccacgccauuguacaaacucuagucaauucagucaauucaaaaaucccaaaagcaugcugcguaccuacagaacuaucagcaauuucaaugcuauaccuagacgaaaaugaaaaaguaguacuuaaaaacuaucaagacaugguuguagaaggauguggaugcagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4397 - RNA, 1574 nt, Artificial Sequence
  mRNA product Design3 comprising derived and/or modified sequence from Homo sapiens__NP_001193.2__HsBMP4 (opt6)
gggagagucccgcagucggcguccagcggcucugcuuguucgugugugugucguugcaggccuuauucaagcuuaccaugauacccggaaacagaaugcuaaugguaguauuacuaugccaaguauuacuaggaggagcuagccaugccagcuuaauuccugaaacaggcaaaaagaaaguagcagaaauacaaggacacgcaggaggaagaagaucaggacaaagccaugaacuacuaagagacuucgaagcaacauuacuacaaauguuuggacuacgacgaagaccacaaccuaguaaaagcgcagucauaccagacuauaugagagaucuauaucgcuuacaaagcggagaagaagaagaagaacaaauacauucaacaggauuagaauacccagaaagacccgcaucaagagcaaauacagugaggucauuccaucaugaagaacaucuagaaaauauaccaggaacaucagaaaauucagcauucagauuuuuauucaauuuaaguucuauaccagaaaacgaaguaauaucaucugcagaacuaagauuauucagagaacaaguugaucaaggaccagacugggaaagagguuuucacagaauaaauaucuaugaaguaaugaaaccuccagcagaaguaguuccagggcaucuaaucacaagauuacucgauacaagauuaguacaccauaacguaacacgaugggaaacauuugauguaucaccagcaguucuaagauggacaagagaaaaacaaccgaauuacggauuagcaauagaaguuacucacuuacaucaaacaagaacccaccaaggacaacauguaagaauaucccgaucauuaccacaaggcucaggaaauugggcacaacuaagaccacuccucguaacauuuggacaugacggaagaggacaugcucucaccagaagaagacgagcaaaaagaucaccaaaacaccauagccaaagagcuagaaagaaaaauaaaaauugcagaagacauaguuuauacguugacuucucagauguaggauggaaugauuggauaguagcaccaccugguuaccaagcauuuuauugucacggagacuguccauuuccuuuagcagaucacuuaaacaguacaaaucacgcaauaguacaaacucuaguuaacucaguaaacagcucuauaccaaaagcaugcugugucccaacagaacuaucggcaauuucaauguuauauuuagaugaauaugauaaaguaguacuuaaaaauuaucaagaaaugguaguagaaggaugcggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4398 - RNA, 1889 nt, Artificial Sequence
  mRNA product Design3 comprising derived and/or modified sequence from Homo sapiens__NP_001709.1__HsBMP6 (opt6)
gggagagucccgcagucggcguccagcggcucugcuuguucgugugugugucguugcaggccuuauucaagcuuaccaugccaggauuaggucguagagcacaaugguuaugcugguggugggguuuacuauguucauguuguggcccaccaccccuaagaccaccauuacccgcagcagcggcugcagccgcaggaggacaacuauuaggagauggaggaaguccaggcagaacagaacaaccaccgccaagcccccaaagcucaucuggauuucuauacagaagauuaaaaacacaagaaaagagagaaaugcaaaaagaaauacuaucgguauuaggacugccacaucgacccagaccacuacacggauuacaacaaccccaaccacccgcacuucgacaacaagaagaacaacaacaacaacaacaacuaccaagaggcgaaccuccaccaggaagauuaaaaucagcaccacuauuuauguuagauuuauauaacgcauuaucagcagacaaugacgaagacggagcaucagaaggagaaagacaacaaucauggccccaugaagcagcaucaaguucacaacgaagacaaccaccuccaggagcugcucauccauuaaacagaaaaucacuucucgccccaggaaguggcucuggaggugcaaguccauuaacaucagcacaagauagcgcuuucuuaaaugaugcagauaugguaaugucauuuguaaaucuagucgaauacgauaaagaauuuucaccaagacaacgacaucauaaagaauuuaaauucaauuuaagucaaauaccugaaggugaaguaguuacagcugcugaauuucgaauauauaaagacuguguaaugggaucauuuaaaaaccaaacauucuuaauaucaauauaucaaguuuuacaagaacaucaacauagagauagugaucucuuuuuacuagauacaagaguaguaugggcuagugaagaagguugguuagaauuugacauaacagcuacgaguaauuuauggguuguaacaccacaacauaauaugggucuacaacuuagcguaguuacacgagaugguguacauguacacccaagagcagcaggucuaguaggaagggauggaccuuaugacaagcaaccauucaugguagcauucuuuaaaguaagcgaaguucauguaagaacuacaagaucagcuucaucaagaagaagacaacaaagucgaaacagaaguacacaaagucaagauguugcaagaguauccagugcaucugauuauaacaguagcgaacuaaaaaccgcauguagaaaacacgaauuauacgucagcuuucaagaucuaggauggcaagauuggauaaucgcaccaaaaggauaugcagccaauuauugugauggagaaugcaguuuuccuuuaaaugcacacaugaaugcaacaaaucacgcuauaguucaaacacuuguucacuuaaugaauccugaauacguaccaaaaccauguugcgcaccuacaaaauuaaacgcaauaucaguacuauacuuugaugauaauucaaacguaauacuuaaaaaguauagaaauaugguaguaagagcaugugguugucacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4399 - RNA, 1643 nt, Artificial Sequence
  mRNA product Design3 comprising derived and/or modified sequence from Homo sapiens__NP_001710.1__HsBMP7 (opt6)
gggagagucccgcagucggcguccagcggcucugcuuguucgugugugugucguugcaggccuuauucaagcuuaccaugcauguaagaucacuccgagcagcagcaccacacucauuuguagcauuaugggcaccacuauucuuauuaagauccgcacucgcagacuucaguuuagacaaugaaguacacucaucauuuauacaucgaagauuacgaucccaagaaaggagagaaaugcaaagagaaauacucucaauacuagguuuaccccacagaccaagaccacaccuacaaggaaaacauaauuccgcaccaauguucaugcuagaucuauacaacgcaauggcaguagaagaaggaggaggaccaggaggccaagguuucucauacccauauaaagcaguauucaguacacaaggaccuccacuagcaucccuacaagauucucacuucuuaacugaugcagauauggucaugucauucguuaacuuaguagaacaugauaaagaauuuuuucacccaagauaucaccaucgugaauuuagauucgaccuaucaaaaauuccagaaggagaagccguaacagcagcagaauucaggauuuauaaagacuauauccgagaacgauucgacaacgaaacauucagaauaucaguauaucaagucuuacaagaacaucucggccgagaaucagacuuauucuuauuagauucgagaacucuaugggcaucugaagaaggaugguuaguauuugauauaacagcaacaagcaaucauuggguaguaaacccccgacauaaucuaggauuacaauuaucaguagaaacacuugauggccaaagcauuaacccaaaauuagcaggacuaauaggcagacaugguccacaaaacaaacaaccauucaugguagcauuuuucaaagcaacagaaguccauuucagaaguauaagaucaacaggaaguaaacaaagaucacaaaacagaucaaaaacaccaaaaaaucaagaagcacuaagaauggcuaacguagcagaaaauagcucuagugaccaaaggcaagccuguaaaaaacacgaauuauauguaucauucagagauuuaggauggcaagauuggaucauagcaccagaaggauaugcagcauauuacugugaaggagaaugugcuuucccauuaaacucauacaugaacgcaacaaaucacgcaaucguacaaacacucguacacuuuauuaauccagaaacaguaccaaaacccugcugcgcacccacacaauuaaacgcaauaucaguacuauacuuugacgauucaucaaacguaauauuaaaaaaauacagaaacauggucguaagagcaugugguugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4400 - RNA, 647 nt, Artificial Sequence
  mRNA product Design3 comprising derived and/or modified sequence from Homo sapiens__NP_006264.2__HsCCL7 (opt6)
gggagagucccgcagucggcguccagcggcucugcuuguucgugugugugucguugcaggccuuauucaagcuuaccaugaaagcaucagcagcacuacuaugccuacuacuaacagcagcagcauucucaccacaaggacuagcacaaccaguaggaauaaacacaucaacaacaugcugcuacagauucauaaacaaaaaaauaccaaaacaaagacuagaaucauacagaagaacaacaucaucacacugcccaagagaagcaguaauauucaaaacaaaacuagacaaagaaauaugcgcagacccaacacaaaaauggguacaagacuucaugaaacaccuagacaaaaaaacacaaacaccaaaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4401 - RNA, 3971 nt, Artificial Sequence
  mRNA product Design3 comprising derived and/or modified sequence from Homo sapiens__NP_001954.2__HsEGF (opt6)
gggagagucccgcagucggcguccagcggcucugcuuguucgugugugugucguugcaggccuuauucaagcuuaccauguuacuaacuuugauaauauuauuaccaguuguuucaaaauuuucuuuugugucauuaucugcaccgcaacacuggaguuguccagaaggaacucuagcuggaaauggaaauucuacauguguugggccugcaccauuucuaauauucagccauggaaacucaauuuucagaauagauacugagggaaccaacuaugagcaacucguugucgacgcuggaguaucuguaauaauggauuuucauuacaaugagaaacgcauauacuggguugacuuagaacgacaauuauuacaaagaguauuucuaaauggaagcagacaagaaaggguaugcaauauagagaaaaaugugaguggaauggcaaucaauuggauaaaugaagaagugauauggucaaaccaacaagaaggaauuauaacaguaacagauaugaaaggcaauaauagccauauacuguugagcgcccuuaaauauccagcuaacguagcaguagauccaguagaaagauuuauauuuuggaguucugaagucgcaggaucacuauaccgagcugaccuugauggaguagguguaaaggcuuuacuagaaacaucagagaaaaucacagcaguaagucuugacguacuagauaaaagauuauucuggauccaauauaaccgcgaagggucuaauucccuuauauguucaugugacuacgacggaggcucaguacauauaucaaaacauccgacccaacauaaucuauuugcuaugagccuuuucggggacagaaucuuuuauucgacauggaaaaugaaaacaauuuggauagcaaauaaacacacaggaaaagacaugguaagaauuaauuuacauagcucuuucguaccuuugggagaauuaaaaguaguacauccguuggcacagccuaaagcagaagacgauacaugggaaccugaacaaaaauugugcaaauugcgaaaaggaaacuguucaucgaccguuuguggacaagacuuacaaagucacuugugcaugugugcggaaggauaugcucuauccagagauagaaaauauugugaagaugucaacgaaugugcuuuuuggaaucauggaugcacacuaggaugcaaaaacacaccagguucuuauuacuguaccuguccaguagguuuuguuuuacuaccagacgguaaaagaugucaccagcuaguaucguguccacgcaacguaucugaauguucucacgauuguguacuuaccagcgaaggaccauuauguuuuuguccggagggaaguguacuagaacgugacgguaaaacauguucaggaugcucaucaccugauaacggugguuguagucaauuaugcgucccacuuaguccuguaaguugggaaugugacugcuucccaggauaugauuugcaauuagaugagaaaagcugugcagccagcggaccucaacccuuucuccuuuucgcaaacagccaagauauaagacauaugcauuuugauggaacugauuauggaacgcuauuaagucaacaaaugggaaugguuuacgcacuagaucaugauccuguagaaaauaaaauauauuuugcucacacagccuuaaaauggauagaacgggcaaauauggacgguagccaaagagaacgacuaaucgaagaaggaguagauguuccugaaggauuagcaguagauuggaucggaagacgauuuuauuggacggauaggggaaaaagccuaauugguagauccgaccuuaauggaaaaagaucaaaaauaauaacaaaagaaaacauaagccaaccacgcggaauugcgguacauccaauggcaaaacggcuauuuuggacagauacaggaauaaacccaagaauagaaaguucuucuuuacagggacuaggacgucuaguaauagcaagcuccgauuuaauuuggcccagugguauaacgauagacuuuuuaacugauaaacuauacuggugugaugcaaagcaaucagucauugaaauggcaaaucuagauggaucuaaaagaagaagacuaacucaaaacgauguaggacacccauuugccguagcaguauuugaagauuauguuugguucucagauugggcaaugccaagcguaaugagaguaaauaaaagaacaggaaaagauagagucagauugcaaggaagcauguuaaaaccguccagucuugucgucguucauccccuugcaaaaccaggugcggauccaugucuauaucaaaacggaggaugugaacauauuugcaagaaacgguuagguacugcauggugcagcugucgagaaggauucaugaaagcgagcgaugguaaaacauguuuagcacucgauggacaucaacuacuagcuggcggagaaguagaccugaaaaaccaagugacaccccuugauauacuuaguaaaaccagaguaagugaagauaauauaacggaaucacaacauauguuaguagcagaaaucauggugagcgaucaagaugauugugcacccguaggauguaguauguaugcaagaugcaucucagaaggagaagacgcaaccugccagugcuuaaaaggcuuugccggcgacggcaaacugugcucagauauugaugagugcgaaaugggugugcccguuuguccuccagcgucauccaaauguauaaauacagaaggagguuauguauguagaugcagcgaggguuaucaaggugauggcauacacuguuuggauaucgaugaaugucaauuaggagaacauucuuguggggaaaaugcaaguuguacaaauacagaaggagguuauacuuguaugugugcuggccguuuaagugaaccuggcuuaauauguccagacagcacuccgccuccucaccuaagagaggaugaucaccauuacagcguacgcaauagcgauucagaaugcccucuaagucacgacggguacugucuacaugacggaguauguauguacauagaggcuuuagauaaguaugcauguaacugugucguugguuacauaggagaaagaugucaauaucgagauuuaaaauggugggaauuaagacacgcgggacauggccaacaacaaaaaguaauagucguagccgucugcguaguuguucuaguaauguuacuacuacugagucuuuggggugcacacuauuauagaacacaaaaacuacuaucgaaaaaucccaaaaauccauaugaagaaagcaguagagauguaaggucaagacgaccggcugacacagaagaugggaugucaaguugcccacaaccaugguuuguaguaauaaaagagcaucaagaccuuaaaaacggaggucagccaguagcuggagaagacggucaggcugcggaugggaguaugcaaccaacaucuuggagacaagaaccucaacugugcggaauggguacggagcaaggcugcuggaucccugucagcucagacaaaggcagcuguccucaagugauggaacgaucauuccauaugccgucauacgggacacaaacguuggaaggaggaguggaaaaaccacauagucuauuauccgcaaacccauuauggcaacaacgagcauuagauccaccucaucaaauggaauuaacucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4402 - RNA, 857 nt, Artificial Sequence
  mRNA product Design3 comprising derived and/or modified sequence from Homo sapiens__NP_001423.1__HsEREG (opt6)
gggagagucccgcagucggcguccagcggcucugcuuguucgugugugugucguugcaggccuuauucaagcuuaccaugacagcagguagaagaauggaaauguuaugcgcaggaagaguacccgcacuacuacuaugccuaggauuccaccuauuacaagcaguacuaucaacaacaguaauaccaagcugcauaccaggagaaucaucagacaacugcacagcacuaguacaaacagaagacaauccaagaguagcacaaguaucaauaaccaaaugcucaucagacaugaacggauacugcuuacacggacaaugcauauaccuaguagacaugucacaaaacuacugcagaugcgaagucggauacacaggaguaagaugugaacacuuuuuucuaacaguacaucaaccacuaucaaaagaauacguagcacuaacaguaauauuaauaauacuauuucuaauaacaguagucggaucaacauacuacuucugcagaugguacagaaacagaaaaucaaaagaaccaaaaaaagaauacgaaagaguaacaucaggagacccagaacuaccacaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4403 - RNA, 815 nt, Artificial Sequence
  mRNA product Design3 comprising derived and/or modified sequence from Homo sapiens__NP_000791.1__HsFGF1 (opt6)
gggagagucccgcagucggcguccagcggcucugcuuguucgugugugugucguugcaggccuuauucaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggaacaguagacggaacaagagacagaagcgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauucuuagaaagacuagaagaaaaccacuacaacacauacauaucaaaaaaacaugcagaaaaaaacugguucguaggacuaaaaaaaaacggaucauguaaaagaggaccaagaacacacuacggacaaaaagcaauacuauuccuaccauuaccagucucaagcgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4404 - RNA, 1214 nt, Artificial Sequence
  mRNA product Design3 comprising derived and/or modified sequence from Homo sapiens__NP_001997.5__HsFGF2 (opt6)
gggagagucccgcagucggcguccagcggcucugcuuguucgugugugugucguugcaggccuuauucaagcuuaccaugguugggguaggaggaggagacguagaagauguaacaccaaggccaggaggaugucaaauaagcggaagaggagcaagaggauguaaugggauaccaggagcggcagcaugggaagcugcauuaccaagaagaagaccuaggagacauccaaguguuaauccaagaucuagagcagcggggaguccaagaacaagaggaagaagaacagaagaaagaccaagugggucaagauuaggagauagagguagggggagagcauuaccagguggaagauuaggagguagaggaagaggaagagcaccagaaagagugggaggaagaggaaggggaagaggaacagcagcaccaagagcagcaccagcugcaagaggaaguagaccagggccggcaggaacaauggcagcaggaaguauaacaacauuaccagcauuaccagaagacggaggaucaggagcauuuccaccaggacauuuuaaagacccaaaaagauuauauuguaaaaacggaggauuuuuucuaagaauacauccagauggaagagucgauggugugagggaaaaaagugauccgcauauaaaauuacaauuacaagcagaagaacgaggaguuguaaguauaaaaggaguaugugcaaauagauaucuagcaaugaaagaagauggaagauuauuagcaaguaaauguguaacagacgaauguuuuuuuuuugaaagauuagaaagcaauaauuauaauacuuauagaaguagaaaauauacaagcugguauguagcuuuaaaaagaacaggacaauauaaacuaggaaguaaaacaggaccaggacaaaaagcaauacuauuucuaccaaugagcgcaaagucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4405 - RNA, 932 nt, Artificial Sequence
  mRNA product Design3 comprising derived and/or modified sequence from Homo sapiens__NP_002000.1__HsFGF7 (opt6)
gggagagucccgcagucggcguccagcggcucugcuuguucgugugugugucguugcaggccuuauucaagcuuaccaugcacaaauggauacuaacauggauacuaccaacacuacuauacagaagcugcuuccacauaauaugccuaguaggaacaauaagccuagcaugcaacgacaugacaccagaacaaauggcaacaaacguaaacugcucaucaccagaacgacacacaagaucauacgacuacauggaaggaggagacauacgaguaagaagacuauucugcagaacacaaugguaccuaagaauagacaaaagaggaaaaguaaaaggcacucaagaaaugaaaaacaacuacaacauaauggaaauaagaacaguagcagucggaaucguagcaauaaaaggaguagaaucagaauucuauuuagcaaugaacaaagaaggaaaacuauacgcaaaaaaagaaugcaacgaagacugcaacuucaaagaauuaauacuagaaaaccacuacaacacauacgcaucagccaaauggacacacaacggaggagaaauguucguagcacuaaaccaaaaaggaauaccaguaagaggaaaaaaaacaaaaaaagaacaaaaaacagcacacuuccuaccaauggcaauaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4406 - RNA, 974 nt, Artificial Sequence
  mRNA product Design3 comprising derived and/or modified sequence from Homo sapiens__NP_001936.1__HsHBEGF (opt6)
gggagagucccgcagucggcguccagcggcucugcuuguucgugugugugucguugcaggccuuauucaagcuuaccaugaaacuacuaccaucaguaguacuaaaacuauuuuuagcagcaguacuaucagcacuaguaacuggagaaucacuagaaagauuaagaagaggacuagcagcaggaaccucaaauccagacccaccaacaguaagcacagaccaauuauuaccacuaggaggaggaagagacagaaaaguaagagaccuacaagaagcagaccuagaccuauuaagaguaacacuaucaucaaaaccacaagcacuagcaacaccaaacaaagaagaacacggaaaaagaaaaaaaaaaggaaaaggacuaggaaaaaaaagagacccaugccuaagaaaauauaaagacuucugcauacacggagaaugcaaauacgucaaagaacuaagagcaccaagcugcauaugccaccccggauaccauggagaaagaugccacggacuaucacuaccaguagaaaaccgacuauacacauacgaucacacaacaauauuagcaguaguagcaguaguauuaucaucaguaugcuuacuaguaauaguaggacuauuaauguucagauaccacagacgaggaggauacgauguagaaaaugaagaaaaaguaaaacuaggaaugacaaauucacauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4407 - RNA, 2534 nt, Artificial Sequence
  mRNA product Design3 comprising derived and/or modified sequence from Homo sapiens__NP_000592.3__HsHGF (opt6)
gggagagucccgcagucggcguccagcggcucugcuuguucgugugugugucguugcaggccuuauucaagcuuaccauguggguaacuaaacuuuuaccagcguuauuacuccaacacguauuacuacaccuccuauuauuaccaauagcuauaccauaugcagaaggacaaagaaaacgcagaaacaccauacaugaauuuaaaaaaucggccaaaacaacucuaaucaaaauagauccagcauuaaaaauaaaaacaaaaaaaguuaacacagccgaucaaugugcaaaccgcugcacacguaauaaaggccuaccauucacaugcaaagcauuuguauuugauaaagcacguaagcaaugucuaugguuuccauuuaauagcaugagcucuggcguaaaaaaagaauuuggacaugaauuugaccuauacgaaaauaaagacuauauuagaaacuguauuauaggaaaaggaagaucauauaagggcacaguauccauaacaaaaucaggaauuaaaugucaaccauggucauccaugauaccccacgaacauucauuuuuaccaucaaguuauagaggaaaagauuuacaagaaaacuauugccgaaacccaagaggagaagaaggcggaccuugguguuuuacaucaaacccagaagucagauaugaaguuugugauauaccccaauguucagaaguagaauguaugacauguaauggagaaucauauagaggucuaauggaucacacagaaagugguaagauaugccaaagaugggaucaucagacaccacaccgacauaaauuuuuacccgaaagauacccugauaaaggauuugaugauaauuacugucgaaacccugaugggcagccaagaccaugguguuauacuuuagacccccacacaagaugggaauauugcgcuauaaaaacaugcgcggauaauacaaugaaugauacagauguacccuuagaaacuacugaauguauacaaggacaaggugaggguuaucgcggcacugucaauacuauauggaauggcauccccugucaaagaugggauucacaauauccccaugaacaugauaugacaccagaaaacuuuaaauguaaagauuuacgagaaaauuauugccguaauccagaugguucagaaucucccuggugcuuuacaaccgauccaaauaucagagucggguacuguucacagauaccaaauugcgacaugucucauggucaagauuguuauaggggaaacggaaaaaauuauaugggaaacuuaucucaaacuagaucagguuuaacuuguaguaugugggauaaaaauauggaagauuuacacagacauauauucugggaaccugaugcaagcaaacuaaacgaaaacuacuguaggaauccagacgaugaugcacauggcccuuggugcuauacaggaaauccauuaaucccgugggauuauugucccauaucgcgaugugaaggcgacacaacgccaacuauaguaaaccuagaucauccagugauaucaugugcaaaaacuaaacaauuaagagucguaaauggaauaccaacaagaacaaacauuggauggaugguaucacuccgauacagaaauaaacauauauguggaggaucauuaauaaaagaaagcuggguuuuaaccgcaagacaauguuuuccaucucgagaccuuaaagacuaugaagcaugguuaggaauacacgacguacaugguagaggagacgaaaaauguaaacaaguacuaaauguuucccaacuuguauaugguccagaagguucagauuuaguauuaaugaaauuagcgagacccgcaguuuuagaugauuucguaagcaccauagaccuaccgaauuauggauguacuauaccagaaaaaacaaguuguaguguauacggauggggauauacaggccuaauaaauuaugacggauuacuaagagucgcacacuuauauauaaugggaaacgaaaaauguucacaacaucacagagguaaaguaacauuaaaugaaagugaaauaugugcaggagcugaaaaaauaggcucaggaccgugugaaggagauuauggaggcccacuaguaugugaacagcacaaaaugagaaugguacuaggaguaauaguaccaggccgaggaugugcaaucccaaacagaccaggaaucuuuguuagagucgcuuacuaugcuaaauggauacauaaaauaauacuaacauauaaaguaccacaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4408 - RNA, 2273 nt, Artificial Sequence
  mRNA product Design3 comprising derived and/or modified sequence from Homo sapiens__NP_005336.3 __HsHSPA1A (opt6)
gggagagucccgcagucggcguccagcggcucugcuuguucgugugugugucguugcaggccuuauucaagcuuaccauggcaaaagcagcagcaauuggaauagauuuggguacaacauacaguugcgugggcguguuucaacacggaaaaguagaaauaauagcaaacgaucaaggaaacaggacaacaccaucauacguggcauuuacagacacagaacgauuaauaggggacgcugcuaaaaaccaaguagcauuaaacccccaaaacacaguguucgaugcgaaaaggcuuauaggucggaaauuuggggaucccguaguccaaagcgauaugaaacauuggccauuccaagucauuaaugauggagauaaaccaaaagugcaaguaaguuacaagggugaaacaaaagcauuuuacccggaagaaauaucaaguaugguacuaacuaaaaugaaggaaauagcugaagcauaccuaggauacccaguaacaaaugcgguaauaacagugccagccuacuuuaacgauucgcaacgacaagcaacgaaagacgcaggggucauagccggucuaaaugucuuaagaauaauaaaugaaccaacagcagcagcgauagcuuacggacuagauagaacaggaaaaggugaaagaaacguacuaauauuugauuugggaggaggaacauuugacguaucgauauuaaccauagaugacggcauauuugaaguaaaggcaacggcaggagacacacaucugggaggagaagacuuugauaaucggcuaguaaaucacuuugucgaagaauuuaaaagaaaacacaagaaagauauaagucaaaacaaaagagcaguaagaagacuuagaaccgccugcgaaagagcaaaaagaacacuaagcucaucaacacaagcaaguuuggaaauagauucauuauuugaagguauagacuucuauacuucaauuacaagagccagauucgaagaacuauguagugauuuauuuagaaguacguuagaaccgguagaaaaagcguuaagagaugcuaaacuagauaaagcucaaauccaugaucuaguauuaguaggaggaaguacaagaauaccaaaagugcaaaaauuacuucaagauuucuuuaacggaagagaucuaaauaaaucgauaaauccagaugaagcgguagcguacggagcagcaguacaagcagcaauauugaugggagauaaaagugaaaacguucaagauuuauuauuacuagauguagccccauuaaguuuaggacucgagacagcugguggaguuaugacagcgcuaauaaaaaggaacucaacaauaccaacaaaacaaacacaaauauuuacaacauauagugauaaucaaccaggaguacuaauacaaguauaugaaggagaaagagcgaugacaaaagacaauaauuuacuuggaagauucgaacuuaguggaauaccaccagcaccacgaggaguaccacaaauagaaguaacguuugauauugacgcaaacggaauacuaaauguaaccgcuacagauaaaagcacaggaaaagcaaacaaaauaacuauaacaaaugauaaagguagauuaaguaaagaagaaauagaacguaugguacaagaagcagaaaaauacaaagcagaagacgaaguacaaagagaaagggucagcgcgaaaaaugcacuagaaaguuacgcauucaauaugaaaagugcaguagaagaugaaggacucaaaggaaaaauaagugaagcagauaaaaagaaagucuuagauaaaugucaagaagugauaagcuggcuagaugcaaauacauuagcugaaaaagacgaauuugaacauaaaagaaaagaacuagagcaaguaugcaacccaauaauaaguggcuuguaccaaggggcaggaggaccggggccaggaggcuuuggagcucaaggaccuaaaggaggaagcgguagcggaccaacaauagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4409 - RNA, 2273 nt, Artificial Sequence
  mRNA product Design3 comprising derived and/or modified sequence from Homo sapiens__NP_005337.2 __HsHSPA1B (opt6)
gggagagucccgcagucggcguccagcggcucugcuuguucgugugugugucguugcaggccuuauucaagcuuaccauggcaaaagcagcagcgauaggaauagauuuagggacaacuuauaguuguguaggaguauuccaacauggaaaaguagaaauaauagcuaaugaccaaggaaauagaacaacuccuaguuauguagcauuuacagacacagaaagacuaauaggagacgccgcuaaaaaucaaguagcccucaauccacagaauacaguauucgacgcaaaaagacuuauagguaggaaauucggagauccagugguacaaagcgauaugaaacauuggccauuucaaguaauaaaugacggagauaaaccaaaaguacaaguaucauacaaaggagaaacaaaagcauuuuauccugaagaaaucucaaguaugguacuaacaaagaugaaggaaauugcagaagcauaucuuggauacccaguaacgaacgcaguaauaacaguaccugccuacuuuaacgacagccaacgucaagcaacuaaagacgcaggaguaauagcuggucuaaacguacuuagaauuaucaaugaaccaacugcagccgcaaucgcauacggacuagaccgaacgggaaaaggagaaaggaauguauuaauuuucgaccuaggaggaggaacauucgaugucucuauauuaacuauagacgauggaauuuuugaaguaaaagcaacggcaggagacacgcauuuaggaggagaagauuucgauaaccgucuaguaaaucauuucguugaagaauuuaaaagaaaacauaaaaaggacauuucgcaaaauaaaagagcagugagaagauuaagaaccgccugugaaagagcaaaaagaacauuaagcagcaguacgcaagcaagccuugaaauagauucacuauuugaaggaauagauuucuacacaucaauaacaagagcucgauuugaagaauuauguagcgacuuguucagaucaacauuagagccaguagaaaaagcacuaagagacgcaaaauuagacaaagcacaaauacaugaccuaguauuaguuggaggcaguacacgaauaccaaaaguacaaaaacuucuacaagacuucuuuaauggaagagaucuaaauaaaucaauaaauccagaugaagcaguagccuacggugcggcgguucaagcagcaauacugaugggggacaaaucagaaaauguacaagauuuauuauuauuagauguggcaccacuaucauuaggauuagaaacagcuggagguguaaugacagcacuaauuaaacgaaacagcaccauaccaacgaaacaaacacaaauauuuaccacguacucggacaaucaaccgggaguauugauacaaguauacgaaggagaaagagcaaugacuaaagacaacaaucuauuaggaagauucgaauuaucaggaauaccgccagcaccaagaggaguaccacaaauagaaguaacauucgauauagacgcaaauggcauuuuaaacguaacagcaacagacaaaucaacagguaaagcaaacaaaauaacaauaacaaaugauaaaggaagacuaucuaaagaagaaauagaaagaaugguacaagaagccgaaaaauacaaagcagaagaugaaguucaaagagaacgugugagugccaagaaugcacuugaaucguaugcguucaauaugaaaagcgcaguagaagaugagggccuaaaaggaaaaauaucagaagcagacaaaaagaaagucuuggauaagugucaagaaguaauaaguugguuagaugcaaacacacucgcagaaaaagaugaauuugaacauaaaagaaaagaacuagaacaaguaugcaauccaauaauaucaggguuauaccaaggagcaggcggaccaggacccgggggauucggugcccagggaccaaaaggcgguaguggcagcggaccaaccauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4410 - RNA, 2273 nt, Artificial Sequence
  mRNA product Design3 comprising derived and/or modified sequence from Homo sapiens__NP_005518.3 __HsHSPA1L (opt6)
gggagagucccgcagucggcguccagcggcucugcuuguucgugugugugucguugcaggccuuauucaagcuuaccauggcuacagcaaaaggaauagcaauaggaauagauuuaggaacaacauauucguguguuggaguauuccaacacggaaaaguagaaaucauagcaaaugaccaaggaaacagaacaacaccaagcuauguagcauuuacggauacagaaagauuaauaggagacgcagccaaaaaccaaguagcuaugaauccacaaaauacaguauucgaugcaaaaagacuaauaggaagaaaauuuaaugacccaguaguacaagcagauaugaagcuauggcccuuccaaguuauaaaugaaggagggaaaccaaaaguucuaguaaguuauaaaggugaaaauaaagccuucuauccagaagaaauaucaagcaugguccuaacaaaacuaaaagaaaccgcagaagcauucuuaggacauccugucacuaacgcaguaauaacaguaccagcauacuucaacgauagucaacgucaagcaacaaaagaugcuggaguuauagcaggacuaaauguacuacgaauaaucaacgaaccgacagcagcagcuauagcauauggacucgacaaaggcggacaaggagaaagacacgugcucaucuucgacuuaggcgguggcacauuugauguauccauacuaaccauugacgauggaauuuucgaaguaaaagccacagccggagacacccaucuagggggagaagauuucgauaaccgguuaguaagucacuucguagaagaauuuaaaagaaaacacaagaaagauauaagucaaaauaaacgagcaguaagaagauuaagaacagcaugugaaagagccaaaagaacacuuaguaguucaacacaagcaaacuuagaaauagauucauuauacgaaggaauagauuucuauaccaguauaacaagagcaagauuugaagaacuaugcgcugauuuauuucgcggaacauuagaacccgucgaaaaagcauuaagagaugcaaaaauggauaaagcaaaaauacacgacauaguauuagugggagguagcacgcgaauaccaaagguucaacgauuauuacaagacuauuuuaauggcagagaccucaauaaaaguauaaacccugaugaagcaguugcauacggagcugcaguacaagcagcuauacugaugggagacaaaucagaaaaaguacaagaucuccuacuacuagacguagcuccacuaucacugggucuugagacagcgggaggcguaaugacagcauuaauuaaaaggaacucgaccauacccacaaaacaaacacaaauauuuaccacauauucagauaaccaaccuggagugcuuauucaaguauacgaaggagaaagagcaaugacgaaagauaauaacuugcuaggaagauuugaucuaacagggauuccaccagcaccaagaggcgugccacaaauagaagucaccuucgacauagacgcaaacggaauauuaaacgucacagcaaccgauaaaucaacagguaaggucaauaaaauuacaauaacaaacgauaaaggaagacuaucaaaagaagaaauagaaagaaugguacuagaugcagaaaaauacaaagcagaagacgaaguacaaagagagaaaauagcagcuaaaaacgcgcuagaaaguuacgcauuuaacaugaaaaguguaguaucugaugaaggauuaaaaggcaaaauuucagaaagcgauaaaaauaaaauacuagacaaaugcaaugaacuacuuaguugguuagaaguaaaucaacuagccgaaaaggaugaauuugaccauaaaagaaaagaacuggaacaaauguguaaucccaucauaacaaaacuauaucaaggaggcugcacaggaccagcauguggaaccggauauguaccaggacguccagcaacaggaccaacaauagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4411 - RNA, 2267 nt, Artificial Sequence
  mRNA product Design3 comprising derived and/or modified sequence from Homo sapiens__NP_068814.2 __HsHSPA2 (opt6)
gggagagucccgcagucggcguccagcggcucugcuuguucgugugugugucguugcaggccuuauucaagcuuaccaugucagcaagaggaccagcaauugggauagaucuaggcacaacuuacucaugcguagguguauuccaacacggaaaaguagaaauuauagcaaacgaucaagggaacagaacaacaccaaguuauguagcauuuacagacacugaaagauuaauaggugacgcagcuaaaaaucaaguagcaaugaacccuacaaacacaauuuuugacgcaaaacgacuaaucggaagaaaauucgaagacgcaacaguacaaucagauaugaaacauuggccguucagaguaguaagcgaaggagggaaaccaaaaguacagguugaauacaaaggagaaacaaaaacuuucuucccagaagaaauuaguaguaugguccucacaaaaaugaaagaaauagcagaagcauaccuuggaggaaaaguucacucagcaguaauuacaguaccagcauacuucaacgauucccaaagacaagcaacgaaagacgccgguacaauaacaggauuaaacguguuaagaauuauaaacgaaccuaccgcagcagccauagcguauggauuagauaagaaaggaugugcaggaggagagaaaaauguauuaauauuugacuuaggcggugggacauuugauguaaguauacugacaauagaagaugggauauuugaagucaaaucgacagcaggagacacacauuuagggggagaagacuuugacaacagaaugguaagccaucuagcagaagaguucaaaagaaaacacaagaaagacauaggacccaauaaaagagcugucaggagacuuagaacagcaugcgaaagagcaaaaagaacauuaucaaguucaacacaagcaaguauagaaauagauucgcuauaugaaggaguugauuucuauacaaguauaacaagagcaagauuugaagaacuaaacgccgaucuauuuagaggaacauuagaaccgguugaaaaagcacuuagagacgcaaaauuggauaaaggccaaauacaagaaauuguucuaguaggaggaaguacacgcauuccaaaaauacaaaaacuauuacaagacuuuuucaauggaaaagaacucaauaaaucaauaaacccugaugaagcgguagcguauggugcagccguacaagccgcaauauuaaucggagacaaaagugaaaacguacaagaccuacuauuguuagauguaacaccauuaucacucggaauugaaacagcuggaggaguaaugacaccacucauaaaaagaaauacaaccauucccacaaaacaaacacaaacauucacaacguacagcgauaaccaaaguagcguccuaguacaaguauaugaaggcgaaagagcaaugaccaaagacaacaaucuauuaggaaaauucgacuuaacaggaauaccuccagcaccaaggggaguaccacaaauagaaguuacauuugacauagaugcuaacggaauauuaaacguaacagcagcagauaaaagcacaggaaaagagaauaaaauaacaauuacaaacgauaaaggaagacuaagcaaagacgauauagauagaaugguacaagaagcagaaagauauaaaagcgaagacgaagcuaacagggaucgagucgcagccaaaaaugcauuggaaagcuauacauacaauauaaaacaaacuguagaagaugaaaaauuaagaggaaagauaagugaacaagauaaaaauaaaauuuuagacaaaugucaagaaguuauaaacugguuagauagaaaccaaauggccgaaaaagacgaguacgaacauaaacaaaaagaacuagaaagagucuguaaucccauaauuagcaaauuauaccaaggaggacccggagguggaaguggaggaggaggaucaggagcaagcggaggcccaacaauagaagagguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4412 - RNA, 2870 nt, Artificial Sequence
  mRNA product Design3 comprising derived and/or modified sequence from Homo sapiens__NP_002145.3 __HsHSPA4 (opt6)
gggagagucccgcagucggcguccagcggcucugcuuguucgugugugugucguugcaggccuuauucaagcuuaccaugagcgugguagguauagaucuuggauuccaaucauguuacguugccguagcaagagcaggaggaauagaaacaauagccaacgaauacagugacagauguacaccggccugcauauccuuuggaccuaaaaacagaucaaucggcgcagccgcaaaaucacaagugauuucaaaugcuaaaaacacagugcaagguuucaaaagauuccacggacgagcauuuagcgacccauuuguugaagcagaaaaaucaaacuuagcuuaugauaucguacaauuacccacaggacuaacagguauaaaagucacauauauggaagaggaaagaaacuucacaaccgaacaaguaaccgcgaugcuauuaucaaaacucaaagaaacagcagaauccgucuuaaagaaaccugucguugacuguguaguaucaguacccugcuucuacacagacgcagaaagaagauccguaauggaugccacacaaauagcuggucugaauugcuuacgacuaaugaaugaaacgacggcaguugcauuagcuuacggaauauauaaacaagacuuacccgcacuagaagaaaaaccaagaaacgucguauuuguagauaugggucacagugcauaucaaguguccguaugugcuuuuaacagagguaaacuaaaaguauuagcaacagcuuuugauacuacuuuaggcggacgaaaauuugaugaaguucuaguaaaucauuuuugcgaagaauuugguaagaaauacaaacucgauaucaaaucaaaaauacgugcauuauuacgacuuucacaagaaugugaaaaacuaaagaaauuaaugagugcaaacgcaagcgaccugccuuuaucuauagaauguuucaugaacgauguagauguaucgggcacaaugaacagagguaaauuccucgaaaugugcaacgaucuguuagcaagaguagaaccaccacuacgaaguguauuagaacaaacaaaacuaaagaaagaagacauuuaugcaguagaaauaguuggaggggcaacacgaauaccagcgguaaaagagaaaauuucaaaauucuuuggcaaagaauuaucaacuacacuuaaugcagaugaagccguaacuagaggaugugcacuccaaugugcaauauuaucaccagcuuucaaaguaagagaauuuagcauaacagauguaguaccauacccaauuucacugagauggaacucaccagcagaagaagggucauccgacugcgaaguauucaguaaaaaucaugcugccccuuuuucaaaaguacuaacauucuauagaaaagaaccuuuuacccuagaagcauacuauucaucaccccaagaucuuccauaccccgauccagcaauagcccaauuuagcgugcaaaaaguuacaccucaaagugauggaucaagcaguaaaguuaaaguaaaaguccgugugaacguucaugguauauuuaguguaucuucagccagccuaguagaaguacacaaaagcgaagaaaaugaagaaccaauggaaacggaucaaaaugcuaaagaagaagagaaaaugcaaguagaccaagaagaaccacauguagaggaacaacaacaacaaacacccgcagaaaacaaagccgaaagugaagaaauggaaacaucucaagcaggaucaaaggauaagaaaauggaucaaccuccucaagcgaagaaagcaaaaguaaaaacaucuacagucgaucuuccaauagaaaaccaacuuuuauggcaaaucgauagagaaauguuaaaccuauauauagaaaacgaaggaaaaaugauaaugcaagacaaauuagaaaaagaaagaaacgacgcuaaaaacgcaguagaagaauauguuuaugaaaugagagauaaacugagcggagaauacgaaaaauucguaagcgaagacgaucgaaauucauucacccuaaaacuugaagacacugaaaacuggcucuacgaagauggagaagaccaaccaaaacaaguauacguagauaaacuagcagaacugaaaaaccuaggacaaccaauaaaaauaagauuccaagaaagugaagaacguccuaaauuauucgaagaacuaggaaaacaaauacaacaauauaugaaaaucauaucaaguuuuaaaaacaaagaagaucaauacgaccacuuagaugccgcagacaugacaaaaguagaaaaaucuacuaacgaagccauggaauggaugaauaauaaauuaaaccuccagaacaaacaaucgcuaacaauggauccaguggucaaaucaaaagaaauagaagcaaaaauuaaagaacuaacaaguacuugcucaccaaucauaagcaaaccaaaacccaaagucgaaccaccaaaagaagaacagaaaaacgcagaacaaaauggaccaguagacggccaaggugacaacccaggaccacaagcagcggaacaagguacugacacagcaguacccucagacagugauaagaaacuaccagaaauggauauagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4413 - RNA, 2867 nt, Artificial Sequence
  mRNA product Design3 comprising derived and/or modified sequence from Homo sapiens__NP_055093.2 __HsHSPA4L (opt6)
gggagagucccgcagucggcguccagcggcucugcuuguucgugugugugucguugcaggccuuauucaagcuuaccaugucaguagucggaauugaccuuggauuuuuaaacugcuacauagcaguagcuaggucaggaggaaucgaaacaauagcaaacgaauauagcgauagaugcaccccugccugcauaucauuaggaucacgcacuagagcaaucgggaacgcagccaaaucacaaauaguuacaaacguaagaaauacaauccacggauucaaaaaacuacacggcagguccuuugaugauccaauaguacaaacggaaagaauaagacuacccuacgaacugcaaaaaaugcccaauggaagugcaggcgucaaagucagauaucuagaagaagaaagaccuuuugcaauagaacaaguaaccggaauguuauuggcuaagcuaaaagaaacuucagaaaacgcauuaaagaaaccuguagcagauuguguuauaucaauaccaucguuuuucacagaugcagaacgaagaucaguaauggcagcagcacaaguagccggccuaaacugucuucgacuaaugaaugaaacaacugcaguugcccuagcuuauggaauuuauaaacaagauuuaccuccucuagacgaaaaacccaggaacguaguauucauagauaugggucauagugcauaucaaguucuagugugugcauuuaauaaaggaaaauuaaaaguccuagcaacaacauucgauccguaucuaggagggcgaaacuucgaugaggcacugguagacuacuuuugugacgaauucaaaacgaaauacaagauuaacguaaaagaaaacagcagagcucuucuaaggcuauaccaagaaugugaaaaacucaaaaaauuaauguccgcuaaugccucagaccuaccacuaaauauagaauguuucaugaaugauuuagaugugucaaguaaaaugaacagagcacaauuugaacaauuaugcgcaucauuacuagcucgaguagaaccaccauuaaaagccguaauggaacaagcuaauuuacaacgagaagauaucucaucaauagaaaucguuggaggagccaccagaauuccagcgguaaaagaacaaauuacuaaauuuuuucuuaaagacaucucaacaacacuaaaugcugacgaagcaguugcccggggaugcgcccuccaaugugcaauacuuagcccugcauuuaaaguacgagaauuuucaauaacagacuuaguuccauauucgaucacauuaagauggaaaacaucauucgaagacggcagcggcgaaugugaaguauucugcaaaaaccacccagccccuuuuagcaaaguaauaacauuucauaaaaaagaaccguuugaauuagaagcauuuuacacaaacuuacacgaaguaccauacccugaugcacgaauagguagcuuuacuauacaaaacguauucccacaauccgauggcgacagcucaaaaguuaaaguaaaagucagaguaaacauacauggaauuuucucugucgcaucagcaucuguuaucgaaaaacaaaaucuagaaggggaccauuccgacgccccaauggaaaccgaaacaagcuuuaaaaaugaaaacaaagacaauauggauaaaaugcaaguagaucaagaagaaggacaucaaaaaugccaugcugagcauacaccagaagaagagauagaccacacuggggcaaaaacaaaaucagccguuucagauaaacaagauagauuaaaucaaacacuaaaaaaaggcaagguaaaaucuauugauuuaccaauccaauccucacucugcagacaauuaggacaagaucuauuaaauagcuauauagaaaaugaaggaaaaaugaucaugcaagacaaacuagaaaaagaaagaaacgacgccaaaaaugcaguugaagaauacguauaugauuucagggaccgacuaggaaccguuuaugaaaaauuuauaacgccagaagaccuuucaaaacuaagugcaguauuagaagacacagagaacugguuauaugaagauggagaagaccaaccaaaacaaguauacguugacaaauuacaagaacuaaagaaauacggacaaccaauacaaaugaaauacauggagcacgaagaacguccaaaagcacuaaacgaccuaggcaaaaagauccaacuuguaaugaaaguaauagaagcuuauagaaauaaagaugaacgguaugaccaucuugaccccacagaaauggaaaaaguugaaaaaugcauaagcgacgcaaugagcuggcucaacagcaaaaugaacgcacaaaacaaauuaucacuaacacaagauccaguaguaaaagucagugaaauaguagcaaaaucaaaagaacuagacaauuucuguaauccaauaauauacaaacccaaaccaaaagccgaaguccccgaagacaaaccaaaagcaaacucagaacauaaugguccaauggauggacaaucuggaacagagacaaaaucagacucaacuaaagauucaucccaacauaccaagaguagcggggaaauggaagucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4414 - RNA, 2312 nt, Artificial Sequence
  mRNA product Design3 comprising derived and/or modified sequence from Homo sapiens__NP_005338.1__HsHSPA5 (opt6)
gggagagucccgcagucggcguccagcggcucugcuuguucgugugugugucguugcaggccuuauucaagcuuaccaugaaauuaaguuugguggcagcaaugcuauuauuauuaagcgcugcaagagcagaagaagaggauaaaaaagaagauguugguacggugguuggaauugaccuuggaacaacauacagcugugucggaguauuuaaaaauggaagaguugaaauuauagcuaacgaucaggggaauagaauaacaccaaguuacguagcauucacaccagagggagaaagauuaaucggagacgcagcaaaaaaccaacuuacuaguaauccagaaaauacaguauucgaugcaaaaagauuaauaggaagaacauggaacgacccuuccguacaacaagauaucaaauuccuaccauuuaaaguuguagaaaaaaagacaaaaccauacauacaagucgauauaggaggaggacaaacaaaaacauuugcgccagaggaaaucagugcaaugguauuaacuaaaaugaaagagacagcagaagcauacuuagguaaaaaaguaacacacgcaguagucacaguaccagcauauuuuaacgacgcacaaagacaagcaacaaaggaugcaggaacaaucgcaggauuaaacguaaugagaauaauaaaugagccaacagcagcagcaauugcauauggauuagacaaacgagaaggugagaaaaacauccugguauucgacuuaggagggggcacauuugacguaaguuuauuaacuauagauaauggaguauuugaaguaguagcaacaaacggugacacacauuuaggaggagaagauuucgaucagagaguaauggaacauuuuauaaaauuauacaaaaaaaaaacaggaaaagauguaaggaaagacaauagagcagugcaaaaacuuaggagagaagucgaaaaagcaaaacgagcccuaaguagccaacaucaagcaagaauagaaauagaaagcuuuuaugaaggggaagacuucagugaaacacuuacgagagcaaaauuugaagaauuaaacauggaccuauuuagaagcacaaugaaaccuguacaaaaagugcucgaagauucagaccuaaaaaaaagcgacauagaugagauugucuuaguaggaggaaguacaagaauuccaaaaauccaacaacuaguaaaagaauuuuucaauggaaaagaaccuaguagaggaauaaacccagacgaagcaguagcauauggagcugcaguacaagcuggaguucuaaguggcgaccaagacacaggagacuuaguauuacuagacguauguccguuaacauuaggaauagaaacaguaggaggaguaaugaccaaauugauaccuaggaacacuguuguaccaacgaaaaaaucacaaauauuuaguacagcaucagauaaccaaccaacuguaacuauaaaaguauacgaaggagaaaggccucuaacaaaagacaaucaccuucugggaaccuuugaucucacaggaauaccaccagcaccacggggaguaccgcaaauagaaguaacauucgaaauagacgucaacgguauucuaagaguaacggccgaagauaaaggaacaggaaacaagaauaagauaacuauuacaaaugaccaaaaucgauuaacuccagaagaaauagaacgaauggucaacgacgcagaaaaauuugccgaagaagauaaaaaauuaaaagagagaauagauacucgaaacgaacuagaaaguuacgccuacucacucaaaaaccaaaucggggauaaagaaaaguuaggagguaaauuaucaagugaagauaaagaaacaauggaaaaagcagucgaagaaaaaauugaauggcuagaaucacaccaagacgcagauauagaagauuucaaagcaaaaaaaaaagaauuagaagaaauuguacaacccauaauuaguaaauuauauggaagugcagggccaccaccaacaggcgaagaagacacagcagaaaaagaugaauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4415 - RNA, 2279 nt, Artificial Sequence
  mRNA product Design3 comprising derived and/or modified sequence from Homo sapiens__NP_002146.2__HsHSPA6 (opt6)
gggagagucccgcagucggcguccagcggcucugcuuguucgugugugugucguugcaggccuuauucaagcuuaccaugcaagcaccaagagaacuagcgguaggaauagauuuaggaacaacuuacucauguguaggaguauuucaacaaggaagaguagaaauauuagcaaaugaccaaggaaauagaacaacacccucauacguagccuuuacagacaccgaacgauuaguaggagaugcagcaaaaagccaagcagcacucaacccacauaauacggucuuugacgcaaaaagauuaauaggccgaaaauuugcggauacuacaguacaaagugauaugaaacacuggcccuuucgaguaguaucugaaggaggaaaaccgaagguaagaguauguuaucgaggagaagacaaaacauucuauccagaagaaauaucuucuaugguauugucgaaaaugaaagaaacggcugaagcguaucuaggacaaccaguaaaacaugcaguaauaacuguaccagcuuacuuuaaugauagccagagacaagcaacaaaagaugcaggagccauagcaggauuaaauguauugaggauaauaaaugaaccaacugcagccgcaauagcauacggguuagaccgaagaggagccggugaaagaaaugucuuaauauuugauuugggcggaggaacauuugauguaaguguauuaucaauagacgcaggaguuuuugaagucaaagcaacggcaggagacacacauuuaggaggggaagacuuugauaauaggcuaguaaaucauuucauggaagaauuucgaagaaaacacggaaaagauuuaucuggaaauaaacgagcuuuaagaagguuaagaacagccugugaaagagcaaaaagaacauuaucaucaaguacacaagcaacauuagaaauugacucacucuucgaaggagucgacuucuauacaucaauaacacgagcaagauuugaagaacuaugcucagaucuauuucgaucaacauuagaaccaguggaaaaagcauugcgggaugcgaaauuagacaaagcacaaauacaugacguaguuuuaguaggcggcucaacaagaauaccaaaagugcaaaaacuauuacaagauuucuucaacgggaaagaauuaaacaaaucaauuaauccggaugaagcuguagcuuauggagcagcaguucaagccgccgucuuaaugggagacaaaugcgaaaaaguucaagauuuauuacuacuagauguggcaccacucucucuuggucucgaaacagcgggaggaguuaugacuacguuaauccaaagaaaugcaacaauuccaacaaaacaaacccagacauucacaacauacucugauaaucaaccaggagucuuuauacaaguuuacgaaggcgaacgagcaaugacaaaagauaauaauuuauugggaagauuugaacuuucaggaauacccccagcaccuagaggaguaccucaaauagaaguaaccuucgacauagacgcuaauggaauacuuagcguaacugcaacugauagaaguacaggaaaagcaaacaaaauaacaauaacaaacgauaaaggccgacuaagcaaagaagaaguagaaagaaugguacaugaagcugaacaauacaaagccgaagaugaagcacaacgagauagaguugcagcuaaaaauagucuagaggcacauguauuucauguaaaaggcagccuacaagaagagagcuuaagagacaaaauaccagaagaagacagaagaaaaaugcaagauaaguguagagaaguauuggcaugguuagaacauaaucaauuagcagaaaaagaagaauaugaacaucaaaaacgagaauuagaacaaauaugucgaccaauauuuucaagguuauauggaggcccaggaguaccagggggaaguucaugugguacacaagcaagacaaggugauccgucaacaggaccaaucaucgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4416 - RNA, 1451 nt, Artificial Sequence
  mRNA product Design3 comprising derived and/or modified sequence from Homo sapiens__P48741__HsHSPA7 (opt6)
gggagagucccgcagucggcguccagcggcucugcuuguucgugugugugucguugcaggccuuauucaagcuuaccaugcaagcaccaagagaauuagcuguaggaauagacuuaggaacaacauauuccuguguaggaguauuucaacaaggaagaguagaaauuuuagcaaaugaucaaggaaauagaacaacaccaucauauguagcauuuacugauaccgaaagauuagucggagaugcagcaaagucacaagcagcauuaaauccucacaauacaguuuuugaugcaaaaagauuaauaggaagaaaauucgcugauacaacaguacaaagcgacaugaaacauuggccauuccaaguuguaagcgaagguggaaaaccaaaaguacgaguauguuauagaggagaagacaaaacauucuaccccgaagaaauaucaaguaugguucuaucaaaaaugaaagaaacagcagaagcauauuuaggacaaccaguuaaacaugcaguaauaaccguuccaacauauuuuagcaauagucaaagacaagcaacuaaagaugcaggagcaauagcaggacuuaaaguacugccaauaauaaaugaagcaacagcagcagcaauagccuauggccuagacagaagaggagcuggaaaaagaaacguauuaauauuugauuuaggaggaggaacuuuugauguaaguguauuaaguauugacgcaggcguuuuugaaguaaaagcaacugcuggugauacucacuuggguggagaagauuuugauaauagauuaguaaaucauuuuauggaagaauuuagaagaaaacacggaaaagaucuaaguggaaauaaaagggcauugagaagauuaagaacagcaugugaaagagcaaaaagaacaccuagcucaaguacacaagcaacgcuagaaauagauucauuauucgaaggaguagauuuuuauaaaucaaucacaagggcaagauuugaagaauuaugcagugacuuauucaggagcacauuagaaccaguagaaaaagcauuaagagaugcaaaauuagauaaagcacaaauacaugauuuugugcuaggagggggauuacauucacauccacaaggagcagaaguugcagcaggauuauuacaaagacaaggagcagaacaagaacaccaaccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4417 - RNA, 2288 nt, Artificial Sequence
  mRNA product Design3 comprising derived and/or modified sequence from Homo sapiens__NP_006588.1 __HsHSPA8 (opt6)
gggagagucccgcagucggcguccagcggcucugcuuguucgugugugugucguugcaggccuuauucaagcuuaccaugagcaaagggccagcaguaggaauagauuuagguaccaccuacagcuguguaggaguauuccaacacggaaaaguggaaauaauagcaaaugaccaaggcaauaggacaacaccaucauacguugcauucacagauaccgagcgacuaauuggagaugcagcuaaaaaucaaguagcaaugaauccaacaaauacgguauuugacgcaaaaagacuaauaggcaggagguuugaugacgcaguuguacaaagcgauaugaaacacuggccauuuaugguaguaaaugaugcuggaagaccaaaaguacaaguagaauacaaaggcgaaacuaaaaguuucuaccccgaagaaguaucuucaaugguauuaacaaaaaugaaagaaaucgcagaagcauacuuaggaaaaacgguuacaaacgcaguaguaacaguaccagcauauuuuaacgacucccaaaggcaagcaacaaaagacgcugggacaauugccgggcuuaauguauuaagaaucauaaaugaaccaacagcagcagcaauagccuacggauuagauaagaaaguaggugcagaaagaaacguauuaauauuugacuuaggcgguggaacauuugauguaucaauauuaacaauagaagacggaauauuugaaguaaaaucuacagcuggagacacacaccuaggaggagaagauuucgauaacagaaugguaaaucauuuuauagccgaauuuaaaaggaaacauaagaaagauauaagugaaaauaaaagagcaguaagaagauuaagaacagcaugcgagcgagcgaaaaggacuuuaucaucgagcacacaagcaagcauagaaauugauagccuauaugaagguauagacuuuuacacaucaauaacaagagcccgauucgaagaauuaaacgcagaucuauuuagaggaacguuagacccaguagaaaaagcauuaagagaugcaaaauuagauaaaagccaaauacaugacaucguauugguuggaggaucuacaagaauaccuaaaauacaaaaauuacuacaagacuucuuuaacggcaaagaauuaaacaaaucaauaaauccagacgaagcaguagcguauggugcggcgguacaagccgcuauauuauccggagacaaaagugaaaacguacaagaucuacuauuacuagacguaacaccccuaucauuaggaauugaaacagcaggaggaguaaugacaguuuuaauaaaaagaaauacaacaauaccaacuaaacaaacccaaacauuuacaacuuacagugacaaucaaccaggagugcucauacaaguuuacgaaggagaacgagcaaugacaaaagacaacaaucuauuaggaaaauuugaacuaaccggaauaccaccagcaccuagaggcgugccacaaauagaagucacauuugacauagaugcaaauggaauacuaaacgucagcgcagucgauaaaucaacaggaaaagaaaacaaaauaaccauaacaaacgacaaaggacgccugagcaaagaagauaucgaacgaaugguacaagaagcagaaaaauauaaagcggaggacgaaaaacaacgagacaaaguaagcaguaaaaacagcuuagaaucauaugcauuuaauaugaaagcaacuguagaagacgaaaaauuacaaggaaaaauaaacgaugaagauaaacagaaaauacuagacaaauguaacgagauaauaaauuggcuggacaaaaaucaaacggcagaaaaagaagaauuugaacaucaacaaaaagagcuugaaaaaguuuguaauccaauaauaacaaaacuauaucaaagugcaggaggaaugccaggaggaaugcccggaggauucccuggaggaggcgcacccccaaguggaggagccaguucaggcccaacaauagaagaaguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4418 - RNA, 2387 nt, Artificial Sequence
  mRNA product Design3 comprising derived and/or modified sequence from Homo sapiens__NP_004125.3 __HsHSPA9 (opt6)
gggagagucccgcagucggcguccagcggcucugcuuguucgugugugugucguugcaggccuuauucaagcuuaccaugauaucagcaagcagagcagcagcagcaagacuugugggagcagcagcaucaagaggaccuacagcagcaaggcaucaagauucguggaauggguuaagccaugaggcguuuagacuugugucuaggagagauuacgccagcgaagcaauuaaaggugcgguuguaggaauagaucuaggaacgacaaacucauguguagcagucauggaaggaaaacaagcaaaagugcuagaaaaugcagaaggcgcaagaacaacaccaucaguaguugcauuuacagcagauggagaaagguuaguugguaugccagcaaaaagacaagcaguaacaaauccgaacaauacauuuuacgcuacaaaaagguuaauaggaagaagauacgaugacccagaagugcaaaaagauauuaaaaauguaccuuuuaaaauagucagagcaucuaauggugaugcauggguagaggcccacggaaaacucuacucuccaagucaaauaggagccuucguauuaaugaagaugaaagaaacagcugaaaauuauuuaggacacacagcgaaaaaugcaguaauaacgguaccagcauacuucaacgacagucaaagacaggcaacaaaagacgcaggacaaauaaguggauuaaacguauuaagaguaauaaaugaaccuacagcagcagcauuagcauauggccuagauaaaucagaagacaaaguaauagcgguauaugauuuaggcggaggaacauuugacauuucaauauuagagauacaaaaagguguauuugaaguuaaaaguacaaauggugacacauuuuugggaggagaagauuucgaucaagcacuacuucgacauauaguuaaagaguuuaaaagagaaacagggguagaucucacuaaagauaauauggcauugcaaaggguaagggaagcagcugaaaaagcaaagugcgagcuaagcucaucuguacaaacggauauuaaucuaccauauuuaacaauggacagcucagguccaaaacaucucaauaugaaauuaacaagagcucaauucgaaggaauaguaacggacuuaauaagaagaacuauagcaccaugucaaaaagcuaugcaggaugcggaagugagcaagagugacauaggagaaguuaucuugguagguggaaugacaagaaugccaaaaguucaacagacaguacaagaucuauucgggagagcuccuaguaaagcuguuaauccagacgaagccguagccauaggagcagcaauacaaggaggaguauuagcaggagauguaacugauguacuacuauuagauguaacaccguugagccuuggaauagaaacuuuaggaggaguguucacuaaauuaaucaauagaaauacaacgauaccuacgaagaaaucacaaguauucaguacagcagccgaugggcaaacacaaguagaaauaaaagucugccaaggagaaagagagauggcaggagauaauaaauuguuagggcaauuuacauuaauagguauaccuccagcaccgagaggaguaccucagauagaaguuacauucgauauagaugcaaaugguauaguucauguaucagcaaaagacaaaggaacuggaagagaacaacaaauagugauacaaagcaguggaggacuaaguaaagaugauauagaaaacaugguuaaaaacgcggaaaaauaugcagaagaagauagaagaaagaaagagagaguagaagcaguuaacauggcugaaggaauaauacaugacacugaaacaaaaauggaagaauuuaaagaucagcuaccagcagaugaauguaauaaacuaaaagaggaaauaaguaaaaugagagaauuguuagcuagaaaagacagugagacuggagaaaauauuagacaagcagcaagcucauuacaacaagcaagccucaaauuauuugagauggcauauaagaaaauggcaucagaaagggaaggauccggaucaagcggaacgggagaacaaaaagaagaucaaaaagaagaaaaacaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4419 - RNA, 2375 nt, Artificial Sequence
  mRNA product Design3 comprising derived and/or modified sequence from Homo sapiens__NP_079291.2__HsHSPA12A (opt6)
gggagagucccgcagucggcguccagcggcucugcuuguucgugugugugucguugcaggccuuauucaagcuuaccauggcagacaaagaagcaggcggaagugaugggccaagagaaacagcaccaacaucagcauacaguucaccagcaagaagccuaggagacacaggaauaaccccauuaaguccaucgcacauuguaaacgacacagacuccaacguaagcgaacaacaaaguuuccuaguaguaguagcuguagauuuuggaaccacaucaucaggauacgcauacucauuuacaaaagaaccugaauguauacaugucaugagaagaugggaaggcggagauccuggaguaaguaaucaaaaaacuccaacaacaauacuucucacaccagaacgaaaauuccacucauuuggauaugcagccagagacuuuuaccacgauuuagauccaaaugaagcaaaacaaugguuauaccuagaaaaauucaaaaugaaacuucauaccacuggagauuuaacaauggacacagaccuaacagcagccaauggaaaaaaaguaaaagcacuagagauauuugcauacgcacuacaauacuuuaaagaacaagcacuaaaagaauuaagcgaccaagcagguuccgaauuugaaaauucagacguaagauggguaauaacaguccccgcaauauggaaacaacccgccaagcaauuuaugagacaggcagcauaccaagcgggacuagccuccccagaaaacucagaacaacuaauuauagcacuugaaccagaggcagcgucaauauauuguagaaaacuacgauuacaucaaaugauagaauuaaguucaaaagcagcaguaaauggauacucaggaucagauacagugggagcaggauuuacacaagcuaaagaacauauuagaagaaacagacaaagcagaacauuucuuguagaaaacgucauaggagaaauaugguccgaacuagaagaaggagauaaauauguaguaguugacagcggaggaggaacaguagaucuaacuguccaucaaaucagacuacccgaagggcacuuaaaggaacuauacaaagcaacgggaggcccauacggcucauuaggaguugacuacgaauucgaaaaauuauuauacaaaauauucggagaagauuuuauagaacaauuuaaaaucaaaaggccugcagcauggguagauuuaaugauagcauuugaaagcagaaaaagagccgcagcacccgauagaacaaacccacuaaauauaacacuaccguucucauuuauagauuacuauaaaaaauuuagaggacauucgguagaacaugcacuaagaaaaagcaacguugacuuugucaaauggagcagucaaggaauguuacggaugagcccagaugcaaugaaugcacuauucaaaccaacaauagauaguaucauagaacauuuaagagauuuauuucaaaaaccagaagucaguacaguaaaauuccuauucuuaguaggcggauucgcagaagcaccccuauuacaacaagccguacaagcagcauucggagaucaauguagaauaauaaucccacaagaugucggacucacaauacucaaaggagcaguucuauucggacucgacccagcaguaauuaaaguaagaagaucaccacuuaccuaugguguugguguauuaaauagauauguagaaggaaaacacccuccagaaaaauuauuaguaaaagauggaacaagauggugcacugacguauuugauaaauuuauuucggcagaccaaucaguagcucuaggugaacuuguaaaacgauccuauacaccugcaaaaccaucacaacuagucauaguaauaaauauauacuccucagaacacgauaaugucucauuuaucacugacccaggaguaaaaaaauguggcacauuaagauuagauuugacagguacaagugguacugcaguacccgcacgaagagaaauccagacauuaaugcaauuuggcgacacagaaaucaaagccacagcaauagacauagccacaucuaaaucaguaaaaguaggaauagacuucuuaaauuauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4420 - RNA, 2408 nt, Artificial Sequence
  mRNA product Design3 comprising derived and/or modified sequence from Homo sapiens__NP_443202.3 __HsHSPA12B (opt6)
gggagagucccgcagucggcguccagcggcucugcuuguucgugugugugucguugcaggccuuauucaagcuuaccaugcuugcaguuccagaaaugggacuacaaggacuauauauaggcaguucaccagaacgaaguccgguacccaguccaccgggaucaccaaggacacaagaaaguugcggaauagcaccucuaacaccuagccaaucaccuaaaccugaagugagagcaccacaacaagcgaguuucucgguuguaguagcaauagauuucggaacaacaucaagugguuaugcauuuucauuugcuucagauccagaagcuauacauaugaugcgaaaaugggaaggaggcgauccuggcguagcacaucagaaaaccccuacuugucuauugcuaacaccagaaggagcauuucauaguuuuggauauaccgcucgagauuacuaucaugacuuagauccagaagaagcaagggauugguuauacuuugaaaaauuuaaaaugaaaauacauagugccacggaucuaacauuaaaaacacaauuagaagcaguaaauggaaaaacaaugccagcauuagaaguauuugcacacgcauugagauucuuucgcgaacaugccuuacaagaacuacgcgaacaauccccuuccuuaccagaaaaggauacuguacgauggguauuaacaguccccgcuauauggaaacaaccggcuaaacaauuuaugagagaagcagcauauuuggcuggccuagucagccgggaaaacgcugaacaauuacuaauagcauuagaaccagaagcugcaagcguauacuguagaaaacuaagacuucaucaauuacuagaucuaagcggaagggcaccuggaggagggcgauuaggagaaagaagaucuauagauucaucauuuagacaagcuagagaacaauuaagaagaucacgucacucaagaacauuucuaguugaaucagguguaggcgaacuuugggcagaaaugcaagcaggagacagauauguaguggcugacugcggaggggguacaguugaccuaacaguacaucaauuagaacaaccacacggaacacuaaaagaauuauauaaggcuucaggaggaccauacggggcaguaggaguugaucuagcuuuugaacaacuacuuugucgaauauucggugaagauuuuauagcaacauuuaaaaggcaaagaccugcugcauggguagaucuaacuauagcauucgaggcaagaaaacgaacagcaggaccacauagagcuggugcuuuaaacauuucauuaccauuuucauucauagauuuuuacagaaaacaaagaggacauaauguagaaacagcauuaagaagaaguucaguaaauuuuguaaaauggucuagucaaggaaugcuaagaaugucaugcgaagcuaugaacgaacuauuucaacccacaguauccgguauaauacaacauauagaagcacuauuagcuagaccugaaguacaaggaguaaaauuauuauuuuuaguaggaggauucgcagaaucagcuguguuacaacaugcugugcaagcagcguugggcgcuagaggucuaagaguaguaguuccucacgauguaggacuaacaauacuaaaaggagcaguauuauucggccaagcgccuggaguaguucgaguaagaagaucuccauuaacauauggugugggaguauuaaauagauucgugccagguagacauccaccagagaagcuauuaguaagagauggcaggaggugguguacugaugucuucgaaagguuuguugcagccgaacaaagcguugcacuaggagaagaaguuagaagaucauacuguccagcacggccaggacaaagaagagugcuaauuaacuuauauuguugcgcagcagaagaugcaagauuuauuacagacccagguguaagaaaguguggagcccucaguuuagaacuugaaccagcugauugcggccaagauacagcaggcgcacccccaggcagacgagaaauaagagcggcaaugcaauuuggagauacagaaauaaaaguuacagcuguagauguaagcacaaacagaaguguuagagcaucaauagacuuucuaaguaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4421 - RNA, 1763 nt, Artificial Sequence
  mRNA product Design3 comprising derived and/or modified sequence from Homo sapiens__NP_008879.3__HsHSPA13 (opt6)
gggagagucccgcagucggcguccagcggcucugcuuguucgugugugugucguugcaggccuuauucaagcuuaccauggcuagagaaaugacaauacucggcucugcaguauuaaccuuacuauuagcaggauauuuagcacaacaauaccuucccuuaccaacaccaaaaguaauagguauagaucucgguacaacauauuguuccgucggaguuuucuuuccaggaaccggaaaaguuaaaguuauaccagacgaaaauggacacauauccauaccaaguaugguaaguuuuaccgacaacgauguauaugucgguuacgaaagcguagaauuagcagauaguaauccacaaaacacaauauaugacgcaaaaagauucauaggaaaaaucuucaccgcagaagaacuggaagcagaaauaggaagauauccauucaaaguacuaaauaaaaauggaaugguagaauucucaguaacuuccaaugaaacaauaacaguaucaccagaauaugucggcucaagauuauuauuaaaauuaaaagaaauggcagaagcauacuuaggaaugccaguagcaaacgcaguaaucucaguaccagccgaauucgauuuaaaacaaagaaauuccacuauagaagcagcaaaucuagcaggucuuaaaauauuaagaguaauaaaugaacccacagcagcagcaauggcauauggacuacacaaagcagauguuuuucacguacuagugauagauuuaggaggcggcacauuagacguaagucuacucaauaaacaaggcgguauguuucuaacaagagccaugaguggaaacaacaaauuaggaggacaagacuuuaaccaaagacuacuacaauauuuauacaaacaaauuuaccaaacauauggauucgucccaucaagaaaagaggaaauccacagacuaaggcaagcaguagagauggucaaacuaaacuuaacauuacaucaaucagcacaacuaucagucuuauuaacaguagaagagcaagauagaaaagaaccucacuccagugacacagaacucccuaaagauaaacuaucaucagcagaugaccaccgagucaacaguggauucggaagaggccuaagugacaaaaaaagcggagaaucacaaguauuauuugaaacugaaauuagcagaaaacuauuugauacauuaaaugaagaccuauuucaaaaaauacuaguaccaauacaacaaguacucaaagaaggacauuuagaaaaaacagaaauagacgaaguaguacuaguaggaggaagcacacgaauuccuagaauaagacaaguaauacaagaauuuuucggcaaagacccuaauacaucaguagacccagaucuagccgucguaacaggaguagcaauacaggcaggaauagauggaggaagcuggccacuucaagucagugccuuagaaaucccaaacaaacauuuacaaaaaaccaauuucaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4422 - RNA, 1877 nt, Artificial Sequence
  mRNA product Design3 comprising derived and/or modified sequence from Homo sapiens__NP_057383.2__HsHSPA14 (opt6)
gggagagucccgcagucggcguccagcggcucugcuuguucgugugugugucguugcaggccuuauucaagcuuaccauggcagcaauaggaguacaccuaggauguacaucagcauguguagccguauauaaagaugguagagcaggaguuguggccaaugaugccggagauagaguaacuccugcaguaguugcauacagcgaaaaugaagagauaguuggacuagcugcaaaacaaagcagaauaagaaauauaaguaauacaguaaugaaagucaaacaaauauuaggaagaucaaguucagacccucaagcucaaaaauacauugcugaaagcaaaugucuaguaauagagaaaaauggaaaacuaagauaugaaauugauacgggugaagaaacuaaauucguaaacccagaagauguagcaagacuaauauuuaguaaaaugaaagaaacagcucauucaguauuaggaucagacgcaaaugacguaguaauaacuguaccauucgauuuuggagaaaaacaaaagaacgcuuuaggagaagcggcuagagcagcagguuuuaauguauuaagacuaauacaugaaccauccgcugcacuauuagcauacggaauaggacaagauaguccaacagguaaaucaaauauccuaguauucaaauuaggaggaacaucauuaucguuaucaguaauggaaguaaauagugggauauauagaguauugagcacaaauacagaugauaauauaggcggagcacauuuuacagaaacucuagcacaauaucuagcaagugaauuucaaagaaguuuuaaacaugauguucgaggaaaugcaagagcaaugaugaaauuaacaaauucagcggaaguagcaaaacacucauuaagcacguuagguagugcaaauuguuucuuagauaguuuauaugaaggacaagauuuugauuguaauguaucacgagcccgauuugaauuauuauguagcccucuauuuaauaaauguauagaagcaauaaggggauuacucgaucaaaauggauucacagcugaugauauaaauaaaguaguauuauguggagguucaaguagaauaccuaaauuacaacaacuaauaaaagacuuauuuccagcaguagaacugcuaaauaguauaccgccagacgaaguaauaccaauaggagcagcaauugaagccggaauacuaauuggaaaagaaaaucuauuaguagaagacagccuuaugauagaauguagugcaagagacauacucgucaaaggcguagaugaauccggagcaaguagauucacuguauuauucccaucaggaacgccacuaccagcaagaagacaacauacacuacaagcaccaggaagcauaucaaguguaugucuagaacuauaugaaucagacgggaaaaauagcgcaaaagaagaaacaaaauuugcacaaguaguauuacaagauuuagacaagaaagaaaauggauuaagagauauauuagcaguauuaacuaugaaacgagacggaagucuacauguaacauguacagaucaagagacaggaaaaugugaagcgauaucaauagaaauugcuagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4423 - RNA, 2924 nt, Artificial Sequence
  mRNA product Design3 comprising derived and/or modified sequence from Homo sapiens__NP_006635.2 __HsHSPH1 (opt6)
gggagagucccgcagucggcguccagcggcucugcuuguucgugugugugucguugcaggccuuauucaagcuuaccaugucaguaguaggacuugauguaggaucacaaucauguuauauagcaguagcacgagcaggagguauagaaacaauagcaaaugaauucagcgauagauguacaccuucagucauaucuuucggaucaaagaaucgaaccauuggcguagccgcaaaaaaccaacaaaucacgcacgcuaacaauacaguaucaaacuuuaaaagauuucacggucgagcguuuaaugaccccuucauucaaaaagaaaaagaaaacuuaagcuaugaccuuguaccacuuaaaaauggaggaguaggcauuaaaguaauguacaugggagaagaacaccuauuuaguguagaacaaaucaccgcgaugcuacuaacaaaacuaaaagaaacagcagagaauagccuaaaaaaaccaguuacugacugcguaauaaguguaccaucuuucuuuaccgacgcagaaagacgguccguucuagaugcagcccaaauaguaggauuaaacugucucagacuaaugaaugauaugacugcaguggcucuaaauuauggaauauauaaacaagacuugccaucacuagaugaaaaaccaagaaucguagucuucgucgauaugggccauagcgcauuucaaguuucagcaugugcuuucaacaaaggaaaacugaaaguucuaggaacggcauucgauccauuucuagggggaaaaaauuuugacgaaaaauuaguagaacacuuuugcgccgaauucaaaacaaaauacaaacuagacgcaaaaaguaaaauaagagcauuauugagauuauaccaagaaugcgaaaaacuaaaaaaauuaaugagcuccaacucaacagacuugccauuaaacauagaaugcuucaugaaugauaaagacguauccgguaaaaugaauagaucccaguucgaggaacuaugugccgaacuacuucaaaaaauagaaguaccauuauacucacuauuagaacaaacucaccuaaaagucgaagacguaagugcaguagaaauuguagguggagcaacaagaauaccggcuguaaaagaaagaauagcaaaauucuuuggaaaagauauaucaacaacauuaaacgccgaugaagccguagcuagagggugcgcacuucaaugcgccauauuaucaccagcguuuaaagucagagaauucaguguuaccgaugcaguaccauucccaauaaguuuaauauggaaccaugacucagaagacaccgaaggaguucaugaaguauuuagccgaaaccacgccgcaccauuuaguaaaguauuaacauuucuaagacgugguccauuugagcuugaagcauuuuauucugauccacaaggaguaccauacccagaagcaaaaauaggcagauuugucguacaaaacguaucggcacaaaaagauggagaaaaaucacgagucaaaguaaaggugagaguaaacacacauggaauauucacaauaaguacagccagcaugguggaaaaaguuccaacagaagaaaacgaaaugagcagcgaagcagauauggaaugucuaaaccaaagaccgccagaaaacccagacacagauaagaauguccaacaagacaacucugaagcaggcacucaaccacaaguucaaacagaugcacaacaaacuucacaaucaccaccgucuccagaauuaaccagugaagaaaacaaaauacccgacgcagauaaagcaaacgaaaaaaaaguagaccaaccaccagaagcaaagaaaccaaaaauuaaagucgugaacguagaauuaccaauagaagcaaaucuaguauggcaauuaggcaaagaccuauuaaauauguauaucgagaccgaagguaaaaugauaaugcaagacaaauuagagaaagaacgaaaugaugcaaaaaaugcaguagaagaauauguauaugaauuuagagauaaacuauguggaccguacgaaaaauuuauaugugaacaagaccaucaaaauuuucuacgacuucuaacugagacagaagacuggcuauacgaagaaggagaagaucaagcaaaacaagcguauguagacaaacuagaagaauuaaugaagauagguacaccaguaaaaguacgauuccaagaagcagaagagagaccaaaaauguuugaagaacugggucaaagauuacaacacuaugcaaaaaucgccgcagacuuucgaaacaaagacgaaaaguauaaucauauagaugaaucagaaaugaaaaaagucgaaaaaagugucaacgaagugauggaguggaugaauaacguuaugaaugcacaagccaaaaaaagccuagaucaagauccuguaguaagagcacaagagaucaaaaccaaaauaaaagaacuaaauaacaccugcgagccagugguuacccagccaaaaccaaaaauagaaagucccaaauuagagagaacccccaauggaccaaauauagauaaaaaagaagaagaccuagaggauaaaaauaacuucggagccgaaccaccacaccaaaauggggaauguuaccccaacgaaaaaaauaguguaaacauggauuuagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4424 - RNA, 3347 nt, Artificial Sequence
  mRNA product Design3 comprising derived and/or modified sequence from Homo sapiens__NP_006380.1 __HsHYOU1 (opt6)
gggagagucccgcagucggcguccagcggcucugcuuguucgugugugugucguugcaggccuuauucaagcuuaccauggcugauaaagucagacgacaacggccaagaagaaggguaugcugggcacugguagcaguucugcuagccgauuuauuagcguuaucagauacccuagcuguaaugagcguagacuuaggcagugaaaguaugaaaguggcaauaguaaaaccaggaguacccauggagauuguuuuaaauaaagaaucaagaagaaagacgccaguaauaguaacgcuaaaagagaacgaaagauucuuuggagacucagcagcaaguauggcaauuaaaaacccaaaagcaacccugagauacuuucaacaucuguugggcaaacaagcagacaacccacauguagcgcuauaccaagcgagguuuccugaacacgaacuaacauucgacccacaaagacaaacaguacacuuccaaauaucuucacaacuccaauuuucaccugaggaaguacuuggaauggucuuaaacuacagucgaaguuuggcggaagauuuugccgaacaaccuauaaaagaugcaguaauaacaguaccuguauucuuuaaucaagccgagaggagagcuguauuacaagcugcaagaauggcuggacuuaaaguacuacaacucauaaaugacaauacagcuacugcacuaucauaugguguuuuuagaagaaaagacauaaacacaacugcacaaaauaucauguuuuacgauaugggaagcggaagcacagucugcacuauagucaccuaucagauggugaaaacaaaagaagcaggaaugcagccucaauuacaaauaagaggaguagguuuugacagaacgcuggguggauuagaaauggaacugagauuaagagaacgauuggcaggacuauucaaugagcaacgaaagggucagagagcuaaagacguuagagaaaauccucgcgcaauggcuaaacuuuuacgcgaagcaaauagauuaaagacaguacuuagugcaaacgcagaccauauggcucaaauagaaggacuaauggaugacguagacuuuaaagcaaaaguaacacgaguagaguucgaagaacuaugugcagaucucuuugaaagaguaccugguccaguacaacaagcucuacaaagugcugaaaugucuuuagacgaaauugaacaaguaauauuggucggcggagcaacacgaguuccuagaguacaagaaguauugcuuaaggcaguaggaaaagaagaacuagggaaaaauauaaacgcugacgaagcagcagcaaugggagccguuuaccaagcggcagcacuaagcaaggcuuuuaaaguuaaaccauuuguaguaagagaugcaguuguauauccaauuuuaguagaauuuacucgagaaguagaagaagaaccagggauacacucacuaaaacacaacaaaagaguacucuuuagcaggaugggaccguauccacaacguaaagucauaacauuuaacagauauucucaugauuuuaauuuccauauaaacuacggagacuuaggcuuuuuagguccagaagaucuaaggguauuugguucacaaaaucucacaacgguuaaacuaaaagggguaggagauaguuucaagaaauacccagacuaugaaucuaaaggaauaaaagcacauuuuaaucuagaugaaagugggguauugagucuagaccgagucgagagcguauucgaaacucugguugaagauagugccgaagaggaaucaaccuugacuaaacuagguaauacgauaagcagcuuauucggagguggcacaacaccagaugcaaaagaaaauggaacagacacaguacaggaagaagaagaaagcccggcagagggcucaaaagaugaaccuggggaacaaguagaguuaaaagaagaagcagaagcaccaguggaagacgguucgcaaccaccucccccagagccaaaaggugaugcaacaccagaaggcgaaaaagcaacagaaaaagaaaauggggauaaaucagaagcacaaaagccaagugaaaaagcagaagcuggaccagaaggaguugcuccugcaccagaaggagaaaagaaacaaaaacccgcacgcaaaagaagaaugguagaggaaauaggugucgagcuaguaguauuagaucuaccagaucucccagaagacaaauuggcacaaaguguacaaaaacugcaggacuuaaccuuaagagacuuagaaaaacaagaaagggaaaaagcugcaaauucuuuggaagcauucauauucgaaacacaggacaaauuauaucaacccgaauaucaggaaguauccacagaagaacaaagagaagaaauaucaggaaaacucucagcagcaucaacgugguuggaagaugaaggaguaggugcaacaacaguaauguuaaaagaaaaauuagcagaacuaaggaaacugugccaaggauuauuuuucagagucgaagaaagaaagaaauggccagaacgguuaucugcauuagauaauuuacuaaaccacucuaguauguuucuaaaaggggccagauuaauaccagaaauggaucaaauuuuuacugaaguagaaaugacaacacuagaaaaaguaaucaacgaaacaugggcauggaaaaaugcaacuuuagcagaacaagcaaaauuaccggcaacagaaaaaccagucuuacuaucaaaagacauagaagcgaaaaugauggcauuagacagagaaguccaauaccuacuaaacaaagcaaaguucacaaaacccagaccgcggccaaaagauaaaaacggaacccgagccgagccaccacuaaaugcaagcgcaagugaucaaggggagaagguaauaccgccugcaggacaaacagaagacgcagaaccaaucuccgaaccagaaaaaguagaaacaggaucggaaccuggagauacagaaccccuagaauuaggaggaccuggagcugagccagaacaaaaagaacaaaguacaggacaaaaacgaccucuuaaaaaugacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4425 - RNA, 2546 nt, Artificial Sequence
  mRNA product Design3 comprising derived and/or modified sequence from Homo sapiens__NP_005339.3 __HsHSP90AA1 (opt6)
gggagagucccgcagucggcguccagcggcucugcuuguucgugugugugucguugcaggccuuauucaagcuuaccaugccagaagaaacccaaacacaagaccaacccauggaagaagaggaaguagaaacauucgcuuuccaagcagaaauugcacaauuaaugagucuaauuauaaacacauucuacucaaacaaagaaauauuuuuacgcgaacuaauaagcaacucaagcgaugcauuagauaaaauuagauaugaaucguuaacagauccaagcaaauuagacucaggaaaagaauuacacauaaaucuuaucccaaacaaacaagauagaacacuuaccauagucgacaccggaauaggaaugacaaaagcugaccuaauaaacaauuuagguacaauagcaaaaucggguaccaaagcauucauggaagcacuacaagcaggugccgacaucucgaugauaggacaauuuggaguaggauucuacagcgcauaccuaguagcagagaaaguaacaguuauaacaaagcacaacgacgacgaacaauacgccugggaaucaagugcaggaggaucauucacaguaagaacagacacaggugaaccaaugggcagagguacgaaaguaauacuucaucuuaaagaagaccaaacagaauaccuagaggaaagaagaaucaaagaaauaguaaaaaaacacucacaauucauaggauauccaauaacacucuuuguagagaaagaaagagacaaagaagucagugacgaugaagcagaggaaaaagaagauaaagaagaagaaaaagaaaaagaagaaaaagaaagugaagacaaaccagaaauagaagacguaggaucggaugaggaggaagaaaaaaaagauggagacaaaaaaaaaaagaaaaaaauaaaagaaaaauacauagaucaagaagaacugaacaaaaccaaaccaauauggacaaggaaccccgacgacaucacaaacgaagaauacggagaauuuuacaaaucacuuacaaaugacugggaagaccaccucgccgucaaacacuuuagcguagaaggucaauuagaauucagagcccuacuguuuguaccuagaagagcaccauucgauuuguuugagaauagaaaaaaaaaaaauaauaucaaacuauacguaagaagaguauuuauaauggacaauugcgaagaauuaauaccagaauaucuaaauuuuaucaggggaguagucgacagcgaagauuuaccauuaaacauaucgcgagagauguuacaacaaucaaaaauucugaaaguaauaagaaaaaaucuagucaaaaaaugucuagaacuauucacagaacuagcagaagacaaagaaaacuacaaaaaauucuaugaacaauucucaaaaaauauaaaauugggcauacacgaagacucucagaauagaaaaaaacuaucagaauuacuaagauauuauacgucagcuaguggagacgagaugguaucccuaaaagacuacugcacaaggaugaaagaaaaucaaaaacauauauacuacauaacuggagaaaccaaggaccaagucgcaaacucagcauucguagaaagauuacgaaagcauggacuggaaguaauauacaugauagaacccauagaugaauauugcguacaacaauuaaaagaauucgaaggaaaaacuuuaguaagcguaacgaaagaaggacuagaauuacccgaagaugaagaagagaaaaaaaaacaagaagagaaaaaaaccaaauucgaaaacuuauguaaaauaaugaaagacauauuagaaaaaaaaguagaaaaaguuguaguaucaaacagacuaguaacaagcccauguugcauaguaacaaguaccuacggguggacggcaaacauggaaagaauaaugaaagcccaagcuuuacgagacaauaguacgaugggauacauggcagccaaaaagcauuuagaaauaaacccagaccacagcauaaucgaaacacuuagacaaaaagccgaagcugauaaaaacgacaaauccgugaaagaccucgucaucuuacuuuaugaaacagcauuauuaaguaguggauucucccuagaagacccgcaaacacacgcuaaucgaauauaccgaaugauuaagcucggauuaggaauagacgaagaugacccaacagcggaugauacaagcgcagcaguaacugaagagaugccaccauuagaaggagaugaugauacgucaaggauggaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4426 - RNA, 686 nt, Artificial Sequence
  mRNA product Design3 comprising derived and/or modified sequence from Homo sapiens__NG_005218__HsHSP90AA3P (opt6)
gggagagucccgcagucggcguccagcggcucugcuuguucgugugugugucguugcaggccuuauucaagcuuaccauggacucaagcaaacuagacagcggaaaaggacuacacauaaacuuaguaccaaacaaacaaaaccaaacacuaacaauaguagacacaagaauaggaaugacaaaaacagacuuaauaaacaaccuaggaacaguaacaaaaucaggaacaaaagcauucauggaagcacuacaagcagacgcagacauaucaaugauaggacacuucggaguaggauucuacucagcauaccuaguagcaaaaaaaguaacaguaauaucaaaacacaacaacgacgaacaauacacaugggaaucaucagcaggaggaucauucacaguaagaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4427 - RNA, 2522 nt, Artificial Sequence
  mRNA product Design3 comprising derived and/or modified sequence from Homo sapiens__NP_031381.2__HsHSP90AB1 (opt6)
gggagagucccgcagucggcguccagcggcucugcuuguucgugugugugucguugcaggccuuauucaagcuuaccaugcccgaagaagugcaucauggcgaagaggagguagaaacauucgcuuuucaagcugaaauagcucagcuaaugagccuaauaauaaacacuuuuuacagcaacaaagaaauauuucuccgcgaguuaauaucaaacgcuucagaugcacuugauaaaauaagauacgagagccuaacagacccuaguaaacuagauagcgguaaagaacuaaaaauagacauaauacccaacccgcaagaaagaacacuuacacuugucgauacuggaauaggaaugacaaaagcagaucuaauaaauaacuuaggaacaauagcaaaaucagggacgaaagcguuuauggaagcauuacaagcaggagcagauauuaguaugauaggacaauuuggaguaggauucuacagugcuuaucuuguagcagaaaaaguaguaguaauaacaaaacacaaugacgacgaacaauaugcuugggaaucuucagccggagggucauucacgguuagagcagaccacggagaaccaauaggaagaggcacuaagguaauacuacauuuaaaggaagaucagacagaauaccuugaagaacgaagaguaaaagaaguaguaaaaaaacauucacaauuuauaggauaccccauaacauuauaccuggaaaaagaaagagaaaaagaaauaucugacgacgaagccgaagaagaaaaaggagaaaaagaagaagaagacaaagaugaugaagaaaaaccgaaaaucgaagacguaggaucagacgaagaagacgacucaggaaaagacaaaaaaaaaaaaacaaaaaaaauaaaagaaaaauacauagaucaagaagaauugaacaaaacaaaaccaauauggacaagaaauccagaugauauaacacaagaagaauauggagaauucuacaaaagucuuacaaaugacugggaagaccaucuagcagucaaacauuuuucaguagaaggacaacuagaauucagagcguuauuauuuauaccaagaagagcgccauucgaccuauuugaaaacaaaaaaaaaaaaaacaauauaaaacuauacguaagaagagucuucauaauggacucgugcgaugaauuaauaccagaauacuuaaauuucauaagaggaguagucgauuccgaagacuuaccacuaaauauaucucgagaaauguuacaacaauccaaaauacuaaaagugauaagaaaaaauaucguaaaaaaaugucuugaacuauuuucggaacuugcggaagacaaggaaaauuauaaaaaauuuuaugaagcguucaguaaaaacuuaaagcuaggcauacaugaagacuccacaaauagaagaagacuaagcgaacuauuaagauaccauacaucacaaucaggagacgaaaugacaucucuaagugaauaugugagcaggaugaaagaaacccaaaaaucaauauacuacauaacaggagaaucgaaagaacagguagcaaauucagcauucgucgaacguguacgcaaaagaggauuugaaguaguauacaugacugagccaauagacgaauauuguguacaacaacuaaaagaauucgacggaaaaagucuagucaguguaacaaaagaaggacuagaacuaccagaagaugaagaagaaaaaaaaaaaauggaagaaagcaaagcaaaguucgaaaauuuaugcaaauuaaugaaagaaauacuagauaaaaaagucgaaaaaguuacaauuucaaauagacuagucucaucaccaugcugcauagucacaagcacauacggauggaccgccaauauggaaagaauaaugaaggcacaagcauuaagagauaacagcacgaugggauacaugauggcaaaaaaacaucuugaaauaaauccagaccacccaauagucgaaacacuaagacagaaagcagaagcagauaaaaacgacaaagcuguaaaagaccucgugguccugcucuucgaaacagcauuacugaguucaggauucucgcuggaagacccacagacucauucaaauagaauuuacagaaugauaaaacuaggauuaggaaucgaugaagacgaaguggcagcagaagaaccaaacgccgcggucccagacgaaauaccuccauuagaaggagacgaggaugcaagccgaauggaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4428 - RNA, 2759 nt, Artificial Sequence
  mRNA product Design3 comprising derived and/or modified sequence from Homo sapiens__NP_003290.1__HsHSP90B1 (opt6)
gggagagucccgcagucggcguccagcggcucugcuuguucgugugugugucguugcaggccuuauucaagcuuaccaugcgagcuuuauggguacuaggcuuauguugcguauuacuuacauucggaucaguacgugcagacgaugaaguagauguagaugguacaguagaagaagauuuaggcaaaucaagagaaggaaguaggacagacgaugagguaguacaaagagaagaagaagcaauucaacuagacggacuuaacgcaucucaaauaagagaauuacgagaaaaaucagaaaaauuugcauuccaggcagaaguaaauagaaugaugaaacuaaucauaaauagucucuauaaaaacaaagaaauauucuuacgagaacuaauaucaaaugcaagugaugcuuuagacaaaauacgacuuaucagucuaacagaugaaaaugcacucaguggcaaugaagaacuaacaguuaaaauaaaaugcgauaaagagaaaaauuuacuacauguuacagacaccgguguaggaaugacaagagaagaauuaguuaaaaauuuaggaacaauagcaaaaaguggaacaagugaauuucuaaauaaaaugacugaagcucaggaagauggacaaagcacuucagaacuaauuggacaauucggaguaggauucuacucagcauuccuuguagcugauaaaguaaucguaacuagcaaacacaauaacgacacacaacauauaugggaaucagauucaaacgaauuuagcguaauugcagauccaagaggaaauacacuaggaagagggaccacaauaacauuaguacuaaaagaggaagcaagcgacuacuuagaacucgauacgauuaaaaauuuaguaaagaaauacucacaguuuauaaauuucccaauauacgucuggaguaguaaaacagaaacaguagaagaaccaauggaggaagaagaagcagccaaagaagaaaaagaagaaucggacgacgaagcugcugucgaagaagaagaagaagaaaagaaaccaaaaacaaagaaaguagagaaaacuguuugggauugggaauuaaugaacgauaucaaaccaauauggcaaagacccucaaaagaagucgaagaagacgaauauaaagccuuuuacaagucauuuuccaaagaaucggaugacccaauggcauauauucacuuuacagcagagggagaagucacauuuaaaucuauacuuuuugucccaacaagugcaccgagaggauuauuugaugaauacgguucaaagaaaucagacuauauaaaauuauauguaagaagaguguucauaacagacgacuuucacgauaugaugccgaaauacuuaaacuuuguuaaaggagucguugacagcgaugaccuaccacucaacguaaguagagaaacacuacaacaacauaaacuauugaaaguuauaagaaagaaacucguaagaaaaacuuuagacaugauuaagaaaauagcagacgacaaauauaacgauacauuuuggaaagaguucgguacaaauauaaaacuaggaguaauagaagaccacaguaauagaacccgauuagccaaauuacucagguuccaaucaucgcaucacccaacagacaucacgagcuuagaucaauauguagaaagaaugaaagaaaaacaagauaaaauauacuuuauggcgggaucaucaagaaaagaagccgaaucuucuccauucguugaacgacuauuaaagaaaggauaugaaguaauauaccuaacagaaccuguagaugaauauuguauacaagcacuaccagaauuugauggcaaacgcuuccaaaauguagcaaaagaaggcguuaaauuugaugaaagcgaaaagacaaaagaaaguagagaagcgguugaaaaagaguucgaaccauuauuaaauuggaugaaagacaaagcacuaaaagauaaaauagaaaaagcuguaguaucucaaagauuaaccgaauccccgugcgcacucguagccagucaauauggcuggucagguaacauggaaagaauaaugaaagcucaagcauaucaaacaggaaaagauauaaguacgaacuauuacgcaucucaaaagaaaacauucgaaauaaauccaagacacccacugauaagagauauguuaaggcgaauaaaagaagaugaagacgacaaaacaguucuagacuuagcugucguacuauucgaaacagcaacauuaagaagcggauacuuacuaccagacacaaaagcauauggagauaggauagaacggauguuacgacuaagucucaacauagauccagaugccaaaguugaagaagaaccagaagaggaaccagaagagaccgcagaagacacaacagaagacacagaacaggacgaagacgaagaaauggacguaggaacugacgaagaagaagaaacagcaaaagaaucuacagcagaaaaagacgagcuguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4429 - RNA, 2462 nt, Artificial Sequence
  mRNA product Design3 comprising derived and/or modified sequence from Homo sapiens__NP_057376.2__HsTRAP1 (opt6)
gggagagucccgcagucggcguccagcggcucugcuuguucgugugugugucguugcaggccuuauucaagcuuaccauggcacgagaauuaagagcucuuuuacuaugggguagacgacugagaccauuauuaagggcgccagcccucgcagcaguaccaggaggaaaaccaauacucugcccaagaagaacaaccgcacaauuaggcccaagaagaaauccagcauggucauuacaagcuggaagacuauuuuccacccaaacagcagaagauaaagaagaacccuuacauucaauaauaucaagcacagaaucaguccaaggaucaacaucaaaacaugaauuucaagcagaaacaaagaaacuauuagauauuguugcuagaagccuuuauucugaaaaagaaguauuuauaagagaacuaauuaguaacgcuagcgacgccuuagaaaagcuaagacacaaguuaguaagugauggacaagcauuaccagaaauggaaauacaccugcaaaccaaugcagaaaaaggaacaauaaccauacaagauaccggcauaggaaugacacaagaagaauuaguaaguaaccuuggaacaauagcuagaagcggaucaaaagcauuccucgacgcacuacaaaaccaagcagaagcaucauccaaaauaauuggacaauuuggcguaggauucuauagugccuuuaugguagcagaucgugucgaagucuauucacgaucagcagcaccaggaucacuaggguaucaaugguuaucagacggauccgguguauucgaaauugccgaagccucgggcguaagaacggguacuaaaauaauaauacauuuaaaaucagauugcaaagaauucucuucagaagcacgaguccgagauguaguaacgaaauauucaaacuuuguuaguuuucccuuauauuuaaauggucguagaaugaauaccuuacaagcaauauggaugauggauccaaaagauguuagagaauggcaacaugaagaauuuuauagauauguugcucaagcucaugacaaaccccgauauacuuuacacuacaaaacagacgcaccauuaaauaucaggaguauauuuuaugugccagauaugaaacccucgauguuugaugucaguagagaauuaggaagcaguguggcucuauauucuagaaaaguacucauacaaaccaaagcaacggauauauuaccaaaauggcucagauuuauaagaggaguuguugauucagaagacauacccuuaaaucuuaguagagaacuacuucaagaaucagcauuaauaagaaaauuaagagacguccuucaacaaagauuaauuaaauucuuuauagaccaaucaaaaaaagaugcagaaaaauaugcaaaauucuucgaagacuauggauuauuuaugagagaaggaauaguaacagcaacagaacaagaaguaaaagaggauauagcaaaauuauuacgguacgaaucaucagcauuaccaucaggacaacuuacaucauuauccgaauacgccagucgaaugagagcaggcacaagaaacauauauuaccuaugugcaccaaacagacaucuagcagagcacucaccuuauuacgaagcaaugaaaaaaaaagauacagaaguucuauuuugcuuugaacaauuugacgagcuuaccuuacuccaucuaagagaauuugacaaaaaaaaauuaauaaguguugaaacagacauaguaguugaucauuauaaagaagaaaaauuugaagaucgaagcccagcagcagaaugccuaucagaaaaagaaaccgaagaauuaauggccuggaugcguaauguucuaggaagcagaguuacaaacguaaaaguaacgcuaagauuagauacucauccagccaugguaacugugcuagaaaugggcgcagccaggcacuuccuaagaaugcaacaauuagcaaaaacacaagaagaaagagcacaauuacuucaaccaacacuugagauaaaucccagacaugcauuaaucaaaaaacuaaaccaacuucgugcaagcgaaccaggauuagcacaacuuuuaguugaucaaauauaugaaaacgcaaugauagcagcuggacucgucgaugauccaagagcaauggugggacgccuuaaugaauuauugguaaaagcauuggaacgacauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4430 - RNA, 809 nt, Artificial Sequence
  mRNA product Design3 comprising derived and/or modified sequence from Homo sapiens__NP_000609.1__HsIGF1 (opt6)
gggagagucccgcagucggcguccagcggcucugcuuguucgugugugugucguugcaggccuuauucaagcuuaccaugggaaaaauaucaucacuaccaacacaacuauucaaaugcugcuucugcgacuuccuaaaaguaaaaaugcacacaaugucaucaucacaccuauucuaccuagcacuaugccuacuaacauucacaucaucagcaacagcaggaccagaaacacuaugcggcgcagaacuaguagacgcauuacaauucguaugcggagacagaggauucuacuucaacaaaccaacaggauacggaucaucaucaagaagagcaccacaaacaggcauaguagacgaaugcugcuuccgaucaugcgaccuaagaagacuagaaauguacugcgcaccacuaaaaccagcaaaaucagcaagaucaguaagagcacaaagacacacagacaugcccaaaacacaaaaagaaguacaccuaaaaaacgcauccagaggaucagcaggaaacaaaaacuacagaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4431 - RNA, 890 nt, Artificial Sequence
  mRNA product Design3 comprising derived and/or modified sequence from Homo sapiens__NP_000603.1__HsIGF2 (opt6)
gggagagucccgcagucggcguccagcggcucugcuuguucgugugugugucguugcaggccuuauucaagcuuaccaugggaauaccaaugggaaaaucaaugcuaguacuauuaacauuucuagcauuugcaagcuguugcauugcagcauacagaccaucagaaacacuauguggaggagaauuaguagauacauuacaauuuguauguggagauagaggauucuauuucucaagaccagcaucaagaguuagcagaagaaguagaggaauaguagaagaaugcuguuucagaagcugugauuuagcauuacuagaaacauauugcgcaacaccagcaaaaagugaaagagauguaucaacaccaccaacuguauuaccagauaacuuuccaagauacccaguaggaaaauucuuucaauacgauacauggaaacaaagcacacaaagacuaagaagaggacuaccagcauuauuaagagcaagaagaggacacguucuagcaaaagaacuagaagcauuuagagaagcaaaaagacauagaccacuaauagcauuaccaacacaagauccagcacacggaggagcaccaccagaaauggcaucaaacagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4432 - RNA, 986 nt, Artificial Sequence
  mRNA product Design3 comprising derived and/or modified sequence from Homo sapiens__NP_000591.1__HsIL6 (opt6)
gggagagucccgcagucggcguccagcggcucugcuuguucgugugugugucguugcaggccuuauucaagcuuaccaugaauuccuucucaacaucagccuucggaccaguagccuucucacuaggacuacuacuaguacuacccgcagcauucccagcaccagucccaccaggagaagacucaaaagacguagcagcaccacacagacaaccauuaacaucaucagaacgaauagacaaacaaauaagauacauauuagacggaauaucagcacuaagaaaagaaacaugcaacaaaucaaacaugugcgaaucaucaaaagaagcccuagcagaaaacaaccuuaaucuaccaaaaauggcagaaaaagacggaugcuuccaaucaggauucaacgaagaaacaugccuaguaaaaauaauaacaggacuacuagaauucgaaguauaccucgaauaccuacaaaacagauucgaauccucagaagaacaagcccgagcaguccaaaugucaacaaaaguacuaauacaauucuuacaaaaaaaagcaaaaaaucuagacgcaauaacaacaccagacccaacaacaaacgccuccuuacuaacaaaacuacaagcacaaaaccaaugguuacaagacaugacaacacaccucauacuaagaucauucaaagaauuccuacaauccucacuaagagcacuuagacaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4433 - RNA, 1628 nt, Artificial Sequence
  mRNA product Design3 comprising derived and/or modified sequence from Homo sapiens__NP_002183.1__HsINHBA (opt6)
gggagagucccgcagucggcguccagcggcucugcuuguucgugugugugucguugcaggccuuauucaagcuuaccaugccacuacugugguuaagagguuuccuauuagcaagcugcuggauaauaguaagaagcaguccaacaccagggagcgaaggacacagugcggcaccagacugcccaucaugugcgcuagcagcauuaccaaaagacguuccaaauagucaaccagaaaugguugaagcaguaaaaaaacauauauuaaauaugcuacaucuaaaaaaaagaccagauguaacacaaccaguaccgaaagcagcauuauuaaaugcaauacgaaaauuacaugucggaaaaguaggagaaaacggauauguagaaauagaagacgacauuggaagaagagcagaaaugaacgaauuaauggaacaaacaagugaaauuauaacguuugcagaaucaggaacagccagaaaaacacuacacuuugaaauaucaaaagaaggcucagaccuaucaguuguagaaagagcggaaguaugguuauuucuaaaaguaccuaaagcaaacagaacaagaacaaaaguaacaauuagacuauuucaacaacaaaaacacccacaaggaagucuagauacaggagaagaagcagaagaaguaggauuaaaaggagaaaggagugaauuacuauuaagugaaaaaguaguagacgcaagaaaaucaacauggcacguauuuccaguaucaucaagcauacaacgacuacuagaccaaggaaaauccucauuagauguaagaaucgcaugcgaacaaugucaagaaaguggugcaucauuaguacuauuaggaaaaaaaaaaaaaaaagaagaagaaggagaaggaaaaaaaaaaggaggaggagaaggaggugcaggagcagacgaagaaaaagaacaaagccauagaccauucuuaauguuacaagcaagacaaagugaagaccauccucauaggagaagaagaagaggacuugaaugcgacggaaaaguaaauauauguuguaaaaaacaauucuuuguaagcuuuaaagauauaggauggaacgauuggauaauagcuccaaguggauaucacgcaaauuacugcgaaggagaaugcccaucacacauagcgggaacaagcggaagcucacuaucauuccauagcacaguaauaaaccauuacagaaugagaggacauaguccauucgcaaacuuaaaaucaugcugugucccaacaaaacuaagaccaauguccauguuauauuaugaugacggucaaaauauaauaaaaaaagauauacaaaacaugauaguagaagaauguggcuguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4434 - RNA, 1571 nt, Artificial Sequence
  mRNA product Design3 comprising derived and/or modified sequence from Homo sapiens__NP_002184.2__HsINHBB (opt6)
gggagagucccgcagucggcguccagcggcucugcuuguucgugugugugucguugcaggccuuauucaagcuuaccauggauggauuacccgggagggcacuaggugcagcuugccuauuacuacuagcagcaggauggcuaggaccagaagcauggggaagcccgacaccaccuccuacaccagcagcaccaccaccaccuccuccaccaggaucaccaggaggaagucaagacacauguacaucaugcggaggauuccgaagaccagaagaacuaggaagaguagauggagauuuucuagaagcaguuaaacgacauauacuaucuagacuacaaaugcgaggaagaccaaauauaacacacgcaguuccaaaagcagcaaugguaacagcacuuagaaaauuacaugcagguaaaguacgugaagauggaagaguagaaauaccacaucuagacggucacgcuucaccaggagcugacggucaagaaagaguaucagaaaucaucagcuuugccgaaacugauggacuagcaucaucacgaguuagauuauauuuuuuuauuaguaaugaaggaaaucaaaauuuauucguuguccaagcuucauuauggcuuuauuuaaaauuacuaccuuauguauuagaaaaaggaucaagaagaaaaguaagaguuaaagucuauuuccaagaacaaggucauggagauagauggaauaugguagaaaaaagaguagaccuaaaaagaucaggauggcacacuuucccauuaacagaagcaauacaagcauuauucgaaagaggagaaagaagacuaaauuuagacguucaaugugacucaugucaagaauuagcaguaguaccaguuuuugucgauccaggagaagaaagucauagaccuuuuguaguaguacaagcgagauuaggagauucaagacacagaauaaggaaaagaggauuagaaugugacgggagaacaaacuuauguuguagacaacaauuuuuuauagauuuucgacuaauaggauggaaugauuggauaauagcaccuacaggauauuauggaaauuauugugaaggaaguuguccagcauauuuagcaggaguaccaggaucagcaagcaguuuucauacagcaguaguuaaucaauauagaaugagaggacuaaauccuggaacgguaaauucguguugcauuccuacaaaacuaucaacaaugagcauguuauacuucgaugacgaauauaauauaguuaaaagagacguaccaaacaugauuguagaagaauguggaugugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4435 - RNA, 3806 nt, Artificial Sequence
  mRNA product Design3 comprising derived and/or modified sequence from Homo sapiens__NP_000623.2__HsITGAM (opt6)
gggagagucccgcagucggcguccagcggcucugcuuguucgugugugugucguugcaggccuuauucaagcuuaccauggcucucagaguacuacuacuaacugcacuaacuuuaugccacggcuucaacuuagauaccgaaaacgccaugacuuuucaagaaaaugcaagagguuucggacaaucuguaguacaacuacaaggcucaaggguaguuguaggcgccccucaagaaaucguagccgcuaaucagcgagguucucuuuaucaaugugauuauucaacuggauccugugaacccauccgauuacaaguaccuguagaagcuguaaauaugucacuuggacuaagucucgcugcaacaacaucacccccgcaacuacucgcauguggcccaaccguacaucagacauguucugaaaacacauacguaaaaggauuauguuuccuauuuggcaguaacuuacgacaacaaccacaaaaauucccagaagccuuaagaggauguccucaagaagauagcgauauugcauuccucauagauggaucugguuccauuauaccucaugauuuccggcgaaugaaagaauuuguuucaacagucauggaacaacuaaagaaaucaaaaacauuauuuuccuuaaugcaauauagugaagaguuccgaauacauuuuaccuucaaagaauuucaaaauaacccaaacccgcgaagucucguaaaacccauuacccaacuucuagguagaacucacacagcaacagguauuagaaaaguuguucgagaguuauuuaauauuacaaacggagcacguaaaaacgcuuucaaaauccuaguuguaauaacagacggagaaaaauuuggugacccacuagguuaugaagauguuaucccagaggcugacagagaaggagucauuagauaugucauaggaguaggagaugcauuccgcagugagaaaaguagacaggaacuuaacacgauagccucuaaacccccaagggaucacgucuuccaaguaaacaacuuugaggcuuuaaaaaccauacaaaaccaauugcgugagaaaauuuuugcuauagaagggacacaaacuggauccucaucuucauuugaacaugaaaugucucaagaaggauuuucagcagccaucacaucaaacggaccuuuacuaucaaccguuggcuccuaugauugggcuggaggagucuuccuuuauacuucuaaagaaaaauccacuuuuauaaauaugacccggguugauagcgacaugaaugacgccuauuuggguuaugcagcugcuauaauacuacgaaaucguguccaaaguuuaguccuaggagcucccagauaucagcauauugguuuaguugcgauguuuagacaaaacacagguaugugggaaucaaaugcaaauguuaaaggaacacaaauuggggcauauuucggcgcuucccuauguucaguagacgucgauucaaauggauccacggauuuaguucucauaggugcaccacacuauuaugaacaaacccgagguggccaagucuccguaugcccccuaccacgcggccgugcacguuggcagugcgacgcuguacuuuauggugaacaaggacaaccuuggggacguuuuggagcagcccuaacuguacuuggagacguuaauggcgacaaauuaacggauguugcgaucggggcaccaggcgaagaagauaauagaggagccguauacuuauuucauggcacaagcggcucaggaauaucaccuucacauagucaaagaauagcaggaucaaaacuaucuccaagauuacaauacuuugggcaaagucuaagcggcggacaagaccuuacaauggauggauuaguagaucuaaccguuggagcacaaggacauguauuauuauuaagaucccaaccuguucuuagagucaaagcuauuauggaauuuaacccuagagaaguagcucgcaauguuuuugaauguaaugaucagguuguuaaagguaaagaagcaggagaaguccguguuugucuucacguacagaaaucaacuagggauagacuaagagaaggacaaauacaaaguguuguuacauaugauuuagcacuagacucuggucgaccacauucaagagcaguuuucaacgagacuaaaaacucaacacgaagacaaacccagguauuagguuuaacacaaacuugcgaaacacuuaaacuacaauuaccuaauugcauagaagauccaguuucaccaauaguccuacgauuaaacuucucauuaguuggcaccccacuguccgcuuucggaaaccuacgucccguccucgcagaagacgcacaaagacuauuuacagcuuuauucccuuuugaaaagaauugcggcaaugauaauauaugucaagacgaucuuucaauuacuuuuaguuuuaugucacuagauugccuaguaguaggaggaccaagagaauuuaauguaacaguuacaguacgcaacgacggagaagacucuuaucgaacacaaguuacauuuuucuuuccauuagacuuaaguuaccgaaaaguaucaacccuucaaaaucaacgaucacaaagaucauggagguuagccugcgaaucggcaucauccacugaaguaucuggugcacucaaaaguacuucauguuccauuaaucauccuauauuuccugaaaauuccgaaguaaccuuuaacauaacauuugauguugauucaaaagccucucucgguaauaaauuacuacuuaaagcaaacgugacauccgaaaauaacaugccaagaacuaauaaaacggaauuucaauuagaauuaccuguuaaguacgcagucuacaugguugugacaagucauggcguuuccacaaaauaucuuaacuuuacagcaagugaaaacacaucaaggguuaugcaacaucaauaucaagucaguaaccuuggucaacgaagccuaccaaucucauuggucuuucucgucccaguaagacuaaaucaaaccguaauaugggaucgaccgcaaguuacuuucagugaaaacuuaaguucuacaugccacacaaaagaaagacuuccaucucacucugacuuucuagcugaacuacgaaaagcucccguuguaaacuguucuauagcaguuugucaacguauacaaugugauauuccauucuuuggaauacaagaagaguucaaugcuacauuaaaagguaauuuaucguuugauugguacauuaaaacuagccauaaucauuuauuaauaguuucuacugcagaaauccuguuuaaugauuccguauucacucuauuacccggacaaggagcauuuguaagaucccaaaccgaaacaaaaguagaaccuuuugaaguccccaacccucuuccuuuaaucguuggaucaagcguuggcggacuauuacuuuuagccuuaauaacggcggcauuauauaaauuaggauucuucaaacgccaauauaaagauaugaugucugaagguggaccuccuggagcagaaccacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4436 - RNA, 1751 nt, Artificial Sequence
  mRNA product Design3 comprising derived and/or modified sequence from Homo sapiens__NP_002415.1__HsMMP8 (opt6)
gggagagucccgcagucggcguccagcggcucugcuuguucgugugugugucguugcaggccuuauucaagcuuaccauguuuucacuaaaaacauuaccuuuccuacuucuacuacacguacaaauaucaaaagcauuuccagucucaucaaaagaaaaaaacacaaaaacaguacaagauuaucucgaaaaauuuuaccaauuaccaucaaaucaauaucaaucaacacgaaaaaauggaacaaacguaauaguugaaaaauuaaaagaaaugcaaagauucuuuggacucaaugucacaggcaaaccuaacgaagaaacacuagacaugaugaaaaaaccaagaugcggaguaccagacucaggaggauucauguuaaccccaggcaacccuaaaugggaaagaacaaaucuaacauacagaauacgaaacuauacaccacaacuauccgaagcagaagucgaaagagcaauaaaagacgcuuuugaacuuuggucaguagccuccccacuaauauucacacgaauaucacaaggagaagccgacaucaacauagcauuuuaucaacgagaccacggagacaauucccccuucgacggaccaaauggaauacuagcacacgcauuccaaccuggacaaggaauaggaggagaugcacauuucgacgcagaagaaacauggacaaacacaucagcaaacuacaaccuauucuuagucgcagcacacgaauucggacauucucuaggacuagcccauucaucugaccccggcgcacuaauguauccaaacuacgcauuuagagaaacauccaacuacucccuaccccaagacgauauagaugguauccaagcaauauacggacuauccucaaauccaauacaaccaacaggccccucuacaccaaaaccaugcgacccaucccuuacauucgacgcaauaacaacccuccgaggagaaauauuauucuuuaaagacagauacuucuggagaagacacccucaacuccaacgaguugaaaugaacuucauaucuuuauuuuggccaucucuaccaacagggauccaagcagcuuacgaagauuuugaucgcgacuuaauauuuuuauucaaaggaaaucaauacugggcauuaucaggauaugauauacuacaaggauaccccaaagacauaucaaauuauggauuccccuccucaguccaagccaucgacgcugcaguauucuaccgaucaaaaaccuacuucuuuguaaaugaccaauuuuggagauacgauaaucaacgucaauucauggaaccugguuauccaaaaucaauaucuggcgcauuucccggaauagaaagcaaaguagacgcagucuuucaacaagaacacuucuuccacguauuuagcggaccaagauacuacgccuuugacuuaauagcacaaagaguaacacgaguugcaagaggaaacaaauggcuaaacuguagauacggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4437 - RNA, 2471 nt, Artificial Sequence
  mRNA product Design3 comprising derived and/or modified sequence from Homo sapiens__NP_004985.2__HsMMP9 (opt6)
gggagagucccgcagucggcguccagcggcucugcuuguucgugugugugucguugcaggccuuauucaagcuuaccaugagucuauggcaaccauuaguauuaguuuuacuuguacucgguuguugcuucgcugcaccuagacaacgucaaucaacccucgugcucuuuccaggagaucuucgaacuaauuuaacagauagacaauuagcagaagaauauuuauauagguauggcuauacacgaguagcugaaaugcgaggagaaaguaaaagccuaggaccugccuuauuacuacuacaaaaacaacuaucauuaccagaaacuggagaauuagacuccgcuacucuaaaagcaaugcgcaccccacguugcggaguaccagauuuaggacgauuucaaacauuugaaggagauuuaaaauggcaucaucacaauauaacauacuggauucaaaacuacagugaagauuuacccagggcaguaauagacgaugcauuugcaagggcauuugcauuauggucagcuguuacuccacucacuuucacuagaguuuacaguagagaugcagauaucguaauacaauuuggaguagcagaacacggcgacggauacccauucgacgguaaagauggacuacuagcucaugccuucccaccagguccagguauacaaggagacgcacauuuugaugaugaugaauuauggaguuuaggcaagggaguugucguaccaacucgauuuggaaaugcugauggugcagcuugccauuuucccuuuauuuucgaagggagaucguauucagcuugcacaacagacggaagauccgauggucuaccauggugcucuacaacagcuaacuaugacacagacgauagauucggauucugcccauccgaacgauuauauacucaagauggaaaugcagacgguaaaccaugucaauucccauuuauauuccaaggacaaucauauagcgcuugcacaacagauggaagaagcgauggauacagauggugcgcaacaacagcuaacuaugaucgagacaaacuauuuggauuuuguccaacacgugcugauuccacaguaaugggaggaaauucugcuggugaacuauguguauucccauuuacauuccuugguaaagaauacucuacauguacaagcgaaggcagaggcgacggaagacuuuggugugcuacaacaucuaauuuugauagugauaaaaaauggggauucuguccagaccaaggauacucauuauuucuaguagcugcacaugaauuuggacaugccuuaggauuagaucauaguucuguaccagaagcucugauguauccuauguaccgauucacugaaggaccaccacuccauaaagacgauguuaauggaauaagacauuuguacggacccaggccagaaccagaaccaagaccaccaacaacaacaacuccucaaccgacagcaccaccaacaguuuguccaacaggaccccccacaguacauccaucagaaagaccuacagcaggaccaacagguccgccaucagccggaccaacuggaccuccaacagcaggccccuccacagcaacaacaguaccauuaucaccaguagaugaugcaugcaauguaaauauauuugaugcuauagcagagauaggcaaucaacuauaucucuuuaaagacggaaaauauuggagauucucagagggcagaggaucaagaccccaaggaccauuuuuaauugcagauaaauggccagcuuuaccaaggaaauuagauucagucuuugaagagcgccucucaaaaaaauuauuuuuuuucucaggaagacaagucuggguuuauaccggagcauccguauuaggaccaagaagauuagacaaauuagguuuaggugcugaugucgcacaaguuacaggagcuuuacgaagcggucgaggaaaaaugcuacuguucucugguagaagacuauggagauuugacguaaaagcgcaaaugguagacccucgaagcgcuagugaaguagauagaauguucccugguguaccucuugacacccaugacguuuuucaauacagagaaaaagcauauuuuugccaagaucgcuucuacuggcgaguuaguucacguagcgaacuaaaucaaguagaccaaguuggauaugucacauacgauauacuacaauguccagaagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4438 - RNA, 1763 nt, Artificial Sequence
  mRNA product Design3 comprising derived and/or modified sequence from Homo sapiens__NP_002418.1__HsMMP13 (opt6)
gggagagucccgcagucggcguccagcggcucugcuuguucgugugugugucguugcaggccuuauucaagcuuaccaugcacccagguguacuugcagccuucuuauuuuuaucauggacucacuguagagcacucccacuaccaucaggaggagacgaagaugauuuaucagaagaagaccuccaauucgcagaaagauaucuaagaucuuacuaucacccaacaaacuuagcagguauacuaaaagaaaacgcagcaucaucaaugacagaaagacuaagagaaaugcaaucauucuuuggauuagaaguaacaggaaaacuagaugauaauacacuagacguaaugaaaaaacccagaugcggaguaccugauguaggagaauacaacguauucccaagaacacuaaaauggucaaaaaugaaucuaacauacagaaucguaaacuauaccccagacaugacacauagugaaguagaaaaagcauucaaaaaagcauucaaaguauggucagacguaacaccauuaaacuucaccagacuucacgauggaauagcagacauuaugauuucauuuggcauaaaagaacauggcgacuucuacccauucgacgguccaagcgguuuacuagcccaugcauucccaccuggaccuaacuauggcggagacgcacacuuugacgaugacgaaacauggaccaguucaaguaaaggauacaaucuauuuuugguagcugcccacgaauucggccacucacuaggacuagaccauucaaaagacccuggugcauuaauguucccaauauauaccuauacaggaaaaucacauuucauguuaccagaugaugauguacaaggcauccaaucauuauacggcccaggagacgaagauccaaacccaaaacacccaaaaacaccagacaaaugcgacccuucacuaucucuagacgcaauaacuucuuuaagaggagaaacaaugauauucaaagaucgauucuucuggagacuucacccacaacaaguagaugcagaacuauucuuaacaaaaucuuucuggccagaacuaccaaaccguaucgacgcagcauaugaacacccaucacaugacuuaauauuuauauuuagaggacgaaaauuuugggcauuaaacggauaugauauauuagaaggauacccuaaaaaaauaucagaacucggauuaccaaaagaaguuaaaaaaauaucggcagcuguacacuucgaagacacaggcaaaacccuauuauuuucaggaaaccaaguauggcgauaugacgacacaaaucauauaauggauaaagauuacccaagauuaauagaagaagauuucccaggaauaggugacaaaguagacgcaguauacgaaaaaaaugguuacauauauuuuuuuaacggacccauacaauucgaauacucaauauggucaaacagaauaguacgagucaugccagcaaauucgauacuuuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4439 - RNA, 1415 nt, Artificial Sequence
  mRNA product Design3 comprising derived and/or modified sequence from Homo sapiens__NP_001286.1__HsCCR1 (opt6)
gggagagucccgcagucggcguccagcggcucugcuuguucgugugugugucguugcaggccuuauucaagcuuaccauggaaacaccaaacacaacagaagacuacgauacaacaacugaauucgacuacggagacgcaacaccaugucaaaaagucaacgaacgagcauucggagcacaauuacuaccuccacuauacucauuaguauuuguaauaggcuuagucggaaacauacuaguaguacuaguuuuaguucaauacaaaagacuaaaaaacaugacaucuauauacuuacuaaacuuagcaauaucagaucuucuauucuuauucacccuuccauucuggauagacuacaaauuaaaagacgacuggguauucggcgacgcaaugugcaaaauauuauccggauucuauuacacaggacuauacucagaaauauuuuucauaauacuccuaacaauagacagauaccuagcaauaguucacgcaguauucgcuuuaagagcaagaaccguaacauucggaguuauaacaucaauuauaaucugggcacuagccauacuagccucaaugccaggacuauacuucucuaaaacucaaugggaauucacacaccauacauguucacuccacuuuccccaugaauccuuaagagaauggaaacucuuccaagcacuaaaauuaaacuuauucggacuaguauuaccacuacuaguaaugauaauaugcuacacaggaauuauaaaaauccuacuuagaagaccaaacgaaaaaaaaucaaaagcagucagacuaauauucgucauaaugauaaucuuuuuuuuauucuggacaccuuacaaucucacuaucuuaauaucaguuuuccaagacuuccuauucacacacgaaugugaacaaucaagacacuuagacuuagcaguacaagucacugaaguaauagcauacacacacugcugcguaaacccaguaaucuacgcauucguaggagaaagauuuagaaaauaccuaagacaacuauuccacagaagaguugcuguacaccuaguaaaaugguuacccuucuuaucagucgaucguuuagaaagagucucaucaacaucacccucaacaggugaacacgaacuaucagccggauuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4440 - RNA, 983 nt, Artificial Sequence
  mRNA product Design3 comprising derived and/or modified sequence from Homo sapiens__NP_002598.4__HsPDGFA (opt6)
gggagagucccgcagucggcguccagcggcucugcuuguucgugugugugucguugcaggccuuauucaagcuuaccaugagaacauuagcaugcuuauuacuauuaggauguggauacuuagcacacguauuagcggaagaagcagaaauaccaagagaaguaauagaaagacuagcacgaucacaaauacacucaauaagggaccuacaaagauuacuagaaauagacucaguaggaagcgaagacucacuagacacaucauuaagagcacacggaguacacgcaacaaaacacguaccagaaaaaagaccacuaccaauaagaagaaaaagaagcauagaagaagcaguaccagcaguaugcaaaacaagaacaguaauauaugaaauaccacgaucacaaguagacccaacaucagcaaacuucuuaauauggccaccaugcguagaagugaaaagaugcacaggcugcugcaacacaucgucaguaaaaugccaaccaagcagaguacaccacagaucaguaaaaguagcuaaaguagaauacguaagaaaaaaaccaaaacuaaaagaaguacaaguaagacuagaagaacaccuagaaugcgcaugcgcaacaacaagccuaaacccagacuaccgagaagaagauacaggaagaccgcgagaaaguggaaaaaaacgaaaaagaaaaagacuaaaaccaaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4441 - RNA, 1073 nt, Artificial Sequence
  mRNA product Design3 comprising derived and/or modified sequence from Homo sapiens__NP_002599.1__HsPDGFB (opt6)
gggagagucccgcagucggcguccagcggcucugcuuguucgugugugugucguugcaggccuuauucaagcuuaccaugaauagaugcugggcacuauucuuaagcuuauguugcuacuuaagacuaguaucagcagaaggagauccaauaccagaagaauuauacgaaaugcuaagcgaccacucaaucagaagcuuugacgauuuacaaagacuacuacauggagauccaggagaagaagacggagcagaacuagacuuaaauaugacaagaucacacucaggaggagaauuagaaucacuagcaagaggaagaagaagucuaggaucacuaacaauagcggaaccagcaaugauagcagaauguaaaacacgaacagaaguauucgaaauaucaagaagauuaauagacagaacaaaugcaaacuuccuaguauggccaccaugcguagaaguacaaagaugcucaggauguugcaauaacagaaacguacaauguaggccaacacaaguacaauuaagaccagugcaaguaagaaaaauagaaauaguacguaaaaaaccaauauuuaaaaaagcaacaguaacacuagaagaccaucuagcauguaaaugcgaaacaguagcagcggccagaccaguaacaagaagcccaggaggaagucaagaacaaagagcaaaaacaccacaaacuagaguuacaauaagaacaguaagaguaagaagaccaccaaaaggaaaacauagaaaauucaaacacacacaugauaaaacagcacuaaaagaaaccuuaggagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4442 - RNA, 1385 nt, Artificial Sequence
  mRNA product Design3 comprising derived and/or modified sequence from Homo sapiens__NP_057289.1__HsPDGFC (opt6)
gggagagucccgcagucggcguccagcggcucugcuuguucgugugugugucguugcaggccuuauucaagcuuaccaugagcuuauucggacuacuacuccuuacuucagcacuagcaggacaaagacaaggaacacaagcagaaucaaaccuaagcucaaaauuccaauuuucaucaaacaaagaacaaaauggaguacaagauccacaacacgaaaggauuauuacagucucaacaaacggaaguauacacaguccaagauucccacauacauacccaagaaacacaguuuuagucuggcgacuaguagcaguagaagaaaauguauggauacaacuaacauucgaugaaagauucggauuagaagacccagaagacgacauaugcaaauaugacuuuguagaagucgaagaaccaagugacgguacaauacuaggaagauggugcggaucaggaacaguaccaggcaaacaaauaaguaaaggaaaccaaauuagaauaagauucguaucagaugaauacuuuccaucagaaccaggauucugcauacauuacaacauaguaaugccacaauucaccgaagcaguuucaccaucaguuuuaccaccaagugcccucccauuagaccuacuaaacaacgcaauaacugcauucaguacucuagaagaccuaauaagauaccuagaaccagaaagauggcaauuagaucucgaagaccuauauagaccaacauggcaacuauuaggcaaagcauuuguauucggaagaaaaucaagaguaguagacuuaaaccuauuaacagaagaaguaagacuauacagcugcacaccaagaaacuuuucaguuucaauaagagaagaauuaaaaagaacagauacaaucuucuggccaggaugucuauuagucaaaagaugcggcggaaacugcgcaugcugccuacauaacugcaacgaaugccaaugcguaccaaguaaaguaacaaaaaaauaccacgaaguauuacaacuaagaccaaaaacuggaguaagaggucuacacaaaucacuaacugacguagcauuagaacaucacgaagaaugugacugcgucugcagaggaucaacaggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4443 - RNA, 1442 nt, Artificial Sequence
  mRNA product Design3 comprising derived and/or modified sequence from Homo sapiens__NP_149126.1__HsPDGFD (opt6)
gggagagucccgcagucggcguccagcggcucugcuuguucgugugugugucguugcaggccuuauucaagcuuaccaugcacagacuaauauucguauacacacucauaugcgcaaauuucugcucauguagagacacaucagcaacaccacaaucagcaucaauaaaagcacuaagaaacgccaaccuaagacgagacgauuuauacagaagagacgaaacaauacaaguaaaagguaacggauauguacaaucaccaagauucccaaacaguuacccaagaaaucuacuacuaacauggagacuacacucacaagaaaacacaagaauacaacuaguauuugacaaccaauuuggacuagaagaagcugaaaacgacauauguagauaugacuucguagaaguagaagacauaagugaaacaucaacaauaauuagaggaagauggugcggccacaaagaaguaccaccccgaauaaaaucaaggacaaaccaaaucaaaauaacuuucaaaucagacgacuacuuuguagcaaaaccaggcuuuaaaauauacuauagcuuacuagaagacuuccaaccagcagccgcaagugaaacaaacugggaaagcguaacaucaagcaucucaggaguaagcuauaacucaccaucaguaacagacccaacacuaauagcagacgcauuagacaaaaaaauagcagaauucgacacaguagaagauuuauuaaaauacuucaacccagaaucauggcaagaagaccuagaaaauauguaccucgacacaccaagauauagaggaagaagcuaucacgauagaaaaucaaaaguagaccuagacagacuaaaugacgacgcuaaacgauauaguuguacaccaagaaacuacagugucaacauacgagaagaacuaaaacuagcaaacguaguauucuuuccacgaugucuacuaguacaaagauguggaggaaacugcggaugcggaacaguaaauuggagaucaugcaccugcaacagcggaaaaacaguuaaaaaauaccacgaaguacuacaauucgaaccuggccacauaaaacgaaggggaagagcaaaaaccauggcacuaguagauauccaacuagaucaucacgagagaugugacuguauauguaguucaagaccaccaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4444 - RNA, 1025 nt, Artificial Sequence
  mRNA product Design3 comprising derived and/or modified sequence from Homo sapiens__NP_003946.3__HsSOCS3 (opt6)
gggagagucccgcagucggcguccagcggcucugcuuguucgugugugugucguugcaggccuuauucaagcuuaccaugguaacacacucaaaauucccagcagcaggaaugucaagaccauuagacacaucauuaagacuaaaaacauucucaucaaaaucagaauaucaacuaguaguaaacgcaguaagaaaacuacaagaaucaggauucuacuggucagcaguaacaggaggagaagccaaccuacuccuaucagcagaaccagcaggaaccuuccuaauaagagacucaucagaccaacgacacuucuucacacuaucaguaaaaacacaauccggaacaaaaaaccucagaauacaaugcgaaggaggaucauucucacuacaaucagacccacgcuccacacaaccaguaccaagauucgacugcguacuaaaacuaguacaccacuacaugccaccaccaggagccccaucauuuccaucaccaccaacagaaccaucaucagaaguacccgaacaaccaucagcacaaccacuccccggaucaccaccaagaagagcauacuacauauacucaggaggagaaaaaauaccauuaguacuauccagaccauuaucuucaaacgucgcaacacuacaacaucuaugcagaaaaacaguaaacggacacuuagacucauacgaaaaaguaacccaacuaccaggccccauacgagaauuccuagaccaauacgacgcaccacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4445 - RNA, 830 nt, Artificial Sequence
  mRNA product Design3 comprising derived and/or modified sequence from Homo sapiens__NP_003227.1__HsTGFA (opt6)
gggagagucccgcagucggcguccagcggcucugcuuguucgugugugugucguugcaggccuuauucaagcuuaccaugguaccaucagcaggacaauuagcauuauucgcauuaggaauaguauuagcagcaugucaagcauuagaaaauucaacaucaccacuaucagcagauccaccaguagcagcagcuguaguaucacauuuuaaugacuguccagauucacauacucaauucuguuuucauggaacauguagauucuuaguacaagaagacaaaccagcauguguaugucauucaggauauguaggagcaagaugugaacaugcagauuuauuagcaguagucgcagcaucacaaaaaaaacaagcaauaacagcauuaguaguaguaucaauaguagcauuagcaguacuaauuauaacauguguacuaauacauuguugucaaguaagaaaacauugugaauggugcagagcauuaauauguagacaugaaaaaccaucagcauuauuaaaaggaagaacagcauguugucauucagaaacaguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4446 - RNA, 1520 nt, Artificial Sequence
  mRNA product Design3 comprising derived and/or modified sequence from Homo sapiens__NP_000651.3__HsTGFB1 (opt6)
gggagagucccgcagucggcguccagcggcucugcuuguucgugugugugucguugcaggccuuauucaagcuuaccaugccaccuagcggacucagauuauuacccuuacuacucccacuccuauggcuacuaguacuaacuccaggaagaccagcagcaggacuaaguacauguaaaacuauagacauggaauuaguaaaaagaaaaagaauagaagccauacguggacaaauccuaucuaaauugagacuagccucaccuccaucacaaggagaaguaccaccaggaccccuacccgaagcaguacuagcacuauacaacucaacaagagauagaguagcaggagaaucagcagaaccagaaccagaaccagaagcagauuauuacgcaaaagaaguaacacgcguauuaaugguagaaacacauaacgaaauauaugauaaauucaaacaaucuacacacucuauauacauguucuuuaauacaucagaacucagagaagccguacccgaaccaguauuauuaucaagagcagaacuaagacuucuaagacuaaaacucaaaguugaacaacacguagaacuauaccaaaaauacucaaacaauucuuggagauauuuaucuaacagacuacuagcccccucagacuccccugaauggcuaucauucgacguaacaggaguagucagacaaugguuaucuagaggaggagaaauagaaggauuccgacuuucagcacacuguucuugugauagucgcgacaacacauuacaaguagacauaaacgguuucacaacuggacguagaggagaccuugcaacaauacaugguaugaacagaccauucuuacuacuaauggcaacaccacucgaacgagcacaacaucuacaauccucacgccacagacgagcccuagacacaaacuacugcuucucaucaaccgaaaaaaauuguugcguaagacaauuauacauagauuucagaaaagaccuaggauggaaauggauacaugaaccuaaaggauaccacgccaauuuuuguuuaggcccauguccauacauauggucacuagacacacaauacucuaaaguauuagcucuauacaaccaacacaacccaggcgcaucagcagcaccaugcuguguuccacaagcuuuagaaccauuaccaaucguauauuacguaggaagaaaacccaaaguagaacaauuaucaaacaugauagucagaucauguaaaugcucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4447 - RNA, 1592 nt, Artificial Sequence
  mRNA product Design3 comprising derived and/or modified sequence from Homo sapiens__NP_003229.1__HsTGFB2 (opt6)
gggagagucccgcagucggcguccagcggcucugcuuguucgugugugugucguugcaggccuuauucaagcuuaccaugcauuacugcguacuaucagcauuccuaauacuacaccuaguaacaguagcauuaucccuaucaacuugcuccacccuagacauggaccaauuuaugagaaaacgcauagaagcaauaagaggacaaauuuuaucaaaacucaaacuaacaagcccaccagaagacuacccagaaccagaagaaguaccaccggaagucauuucaauauacaauucaacaagagaccuacuacaagaaaaagcaucaagaagagcugcagcaugugaaagagaacgcagcgacgaagaauacuacgcaaaagaaguauacaaaaucgacaugccuccauucuucccaagcgaaaacgcaauaccaccaacauucuaucgaccauauuuuagaauaguaagauucgacgucucagccauggaaaaaaaugcuagcaauuuaguaaaagcagaauuuagaguuuucagacuacaaaacccaaaagcacgaguccccgaacaacgaauagaauuauaccaaauacuaaaaucaaaagaccuaacauccccaacacaaagauacauagacucaaaaguaguuaaaacccgagcagaaggcgaauggcuaucuuucgauguaacagacgcaguacacgaaugguuacaccacaaagauagaaaccuagguuucaaaauaucucuccacugcccaugcugcacauucguaccauccaacaacuacauaauaccaaacaaaucugaagaauuagaagcaagauucgcaggaauagacgguacaucaaccuacacaucaggagaucaaaaaacaauaaaauccacaagaaaaaaaaauucaggaaaaacaccacaccuacuacuaaugcuacuaccaagcuacagauuagaaucacaacaaacaaacagacgaaaaaaaagagcacuagaugcagcauacugcuucagaaacguacaagacaacugcugucuccgcccacuauacauagauuucaaacgagauuuaggauggaaauggauacacgaacccaaaggauauaacgccaacuucugcgcaggagcaugcccauauuuauggucauccgacacccaacacuccagaguccuaucucucuacaacaccauaaacccagaagcaucagcaucacccugcuguguaucccaagacuuagaaccacuuacaauauuauacuacauaggaaaaacaccaaaaauagaacaacuaucaaacaugauagucaaauccuguaaaugcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4448 - RNA, 1586 nt, Artificial Sequence
  mRNA product Design3 comprising derived and/or modified sequence from Homo sapiens__NP_003230.1__HsTGFB3 (opt6)
gggagagucccgcagucggcguccagcggcucugcuuguucgugugugugucguugcaggccuuauucaagcuuaccaugaaaaugcacuuacaaagagcauuaguuguacuagcacuucucaacuuugcaacaguaucacuaucauuaucaaccugcacaacacuagacuuuggacacauaaaaaaaaaacgaguagaagccauaagaggacaaauacuaucaaaacuaagacuaacaucaccaccagaaccaaccguaaugacacacgucccauaccaaguauuagcccuauacaacaguacaagagaacuacucgaagaaaugcacggagaacgagaagaaggaugcacucaagaaaauacagaaucagaauacuacgcaaaagaaauacacaaauuugauaugauacaaggauuagcagaacacaaugaacuagccguaugcccaaaaggaauaacaucaaaaguauuuagauuuaacguaucaucagucgaaaaaaaccgcacaaaucuuuucagagcagaauuucgagugcuacgaguaccaaauccaucaucaaaaagaaacgaacaacgcauagaacuauuucaaauccuacgaccagacgaacacauagcaaaacaaagauacauaggaggcaaaaaccuccccacaagagguaccgcagaaugguuaucauucgaugucaccgacacaguacgagaaugguuacuaagaagagaaucaaaccuaggcuuagaaauaucaauccacugcccaugccacaccuuucaaccaaauggagacauauuagaaaacauacacgaaguuauggaaauaaaauucaaaggaguagauaaugaagaugaccacggacgaggugaucuuggaagacuaaaaaaacaaaaagaccaccacaacccacaucuaauauuaaugaugauaccuccacacagauuagacaaccccggacagggaggacaaagaaaaaaaagagcacuagauacaaacuauugcuucagaaaccuagaagaaaacugcugcgucagaccuuuauacauagauuucagacaagaucucggauggaaauggguccacgaaccaaaaggauacuaugcaaacuuuugcuccggccccugcccauaucuacgaucagcagacacaacacacucaacaguacucggacuuuauaacacucuaaaccccgaagcauccgccuccccaugcuguguuccacaagacuuagaaccacuaacaauauuauacuauguaggacgaacaccaaaaguugaacaauuaagcaacaugguaguaaaaucaugcaaauguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4449 - RNA, 1733 nt, Artificial Sequence
  mRNA product Design3 comprising derived and/or modified sequence from Homo sapiens__NP_001057.1__HsTNFRSF1B (opt6)
gggagagucccgcagucggcguccagcggcucugcuuguucgugugugugucguugcaggccuuauucaagcuuaccauggcacccguagcugucugggcagcauuagcaguuggauuagaauuaugggcagcugcccacgcacuaccagcccaaguagcauucacaccuuacgccccagaaccuggaucuaccugcagacuaagagaauauuacgaucaaacagcucaaauguguuguucaaaauguucaccaggccaacaugcaaaaguauucuguacaaaaacaucagauacaguaugugauucaugcgaagauucaacuuauacacaauuauggaauuggguucccgaaugccuauccuguggaucaagauguucaucagaucaaguagaaacccaagcauguacaagagaacaaaauagaauauguacaugcagaccagguugguauugugcacuaagcaaacaagaaggaugcagauuaugugccccauuaagaaaaugucgaccaggcuucggaguagcacgaccuggaaccgaaaccucugauguaguaugcaaaccaugugcaccaggaacauuuucaaacacaacaucuucaacagacauaugcagaccacaccaaauauguaacguuguagcaauaccuggcaaugccucaauggaugcaguuuguacaucaacauccccaacaagaucuauggcaccaggagccguacauuuaccacaaccaguuaguacucgaucacaacauacccaacccacacccgaaccauccacugcuccguccaccucauuccuacuaccaaugggacccucuccaccagcugaagguucuacaggagacuucgcacuaccaguuggauuaauaguaggaguaaccgcacuaggacuucuaaucauaggaguaguuaauuguguaaucaugacucaaguuaaaaaaaaaccuuuauguuuacaacgagaagcaaaaguaccacauuuaccggcagauaaagcaagaggaacucaaggaccagaacaacaacaucuauuaauuacagcuccaucaucaucaucaucaucacuagaaucaucagcuucagcacuugaucgaagagcaccuacacguaaccaaccacaagcaccagguguggaagcuucaggugcaggagaagcaagagcaaguacaggaucaucagacaguucaccaggaggucauggaacacaaguaaauguaacuuguauaguaaaugucuguagcucaucagaucauucaucccaaugcucaucucaagccuccucaacaaugggagacacagauuccucuccaucagaaucaccaaaagacgaacaaguaccauuuucaaaagaagaaugugccuucagaucacaacuagaaacaccagaaacuuuauuaggaucaacugaagaaaaaccgcuacccuuaggaguaccagacgccggaaugaaacccucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4450 - RNA, 860 nt, Artificial Sequence
  mRNA product Design3 comprising derived and/or modified sequence from Homo sapiens__NP_002623.2__HsPGF (opt6)
gggagagucccgcagucggcguccagcggcucugcuuguucgugugugugucguugcaggccuuauucaagcuuaccaugccaguaaugagauuauuuccauguuuucuacaauuauuagcaggauuagcacuaccagcaguaccaccacaacaaugggcauuaucagcaggaaauggaaguucagaaguagaaguaguaccauuucaagaaguguggggaagaucauauuguagagcauuagaaagauuaguagauguaguaagugaauauccaagugaaguagaacauauguuuucaccaaguuguguaaguuuauuaagauguacagguuguuguggagaugaaaaccuacauuguguaccaguagaaacagcaaauguaacaaugcaauuauuaaaaauaagaaguggagauagaccaucauauguugaauuaacauuuagucaacauguaagaugugaaugcagaccacuaagagaaaaaaugaaaccagaaagaagacgaccaaaaggaagaggaaaaagaagaagagaaaaacaaagaccaacagauugucauuuauguggagaugcaguaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4451 - RNA, 1586 nt, Artificial Sequence
  mRNA product Design3 comprising derived and/or modified sequence from Homo sapiens__NP_001020537.2__HsVEGFA (opt6)
gggagagucccgcagucggcguccagcggcucugcuuguucgugugugugucguugcaggccuuauucaagcuuaccaugacagauagacaaacugauacagcaccgaguccgaguuaucauuuauuaccaggaagaaggagaacaguagaugcagcagcaucaagaggacaaggaccugaaccagcaccaggaggagggguagaaggaguuggagcuagaggaguagcauuaaaauuauuuguccaguuauuaggaugcaguagauuuggaggagccguaguaagggcaggagaagcagaaccaucaggggcagcacgaagugcaucaaguggaagagaagaaccacaaccagaagaaggagaagaagaagaggagaaagaagaagaaagaggaccacaauggcggcugggugcgagaaaaccaggaaguuggacaggagaagcagcaguaugcgcagauucagcucccgcagcgagagcaccucaagcauuagcaagagcaagcggaagaggaggaagaguagcaagaagaggagcagaagaaucagggccaccucauagcccaaguagaagggguagugcaaguagagcaggaccaggaagagcaagcgaaacaaugaauuuuuuauuaagcuggguacauuggucauuagcgcuauuacuauauuuacaucaugcaaaauggagccaagcagcaccaauggcagaaggaggaggucaaaaccaucacgaaguaguaaaauuuauggauguuuaucaaaggucauacugccacccaauagaaacacuaguagauauauuucaagaauacccagacgaaauagaauauauauuuaaaccaagcuguguaccacuaaugagaugugguggauguugcaacgaugaaggacuagaauguguaccaacagaagaaucuaauauaacaaugcagauaaugagaauaaaaccacaccaaggacaacauauaggagaaaugaguuuuuuacaacauaauaaaugugaauguagaccaaaaaaggauagagcaaggcaagaaaaaaaaucaguaagaggcaaaggaaaaggacaaaaaaggaaaagaaaaaagagcagauauaaaaguuggagcguguauguaggagcaagaugcugucuaaugccauggucacuaccaggaccucauccauguggaccauguagugaacgaagaaaacaucuauuuguacaggauccacaaacauguaaauguagcuguaaaaauacagauaguagauguaaagcaaggcaauuagaauuaaaugaaaggacuuguagaugcgauaaaccuagaagguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4452 - RNA, 1046 nt, Artificial Sequence
  mRNA product Design3 comprising derived and/or modified sequence from Homo sapiens__NP_001165094.1__HsVEGFA (opt6)
gggagagucccgcagucggcguccagcggcucugcuuguucgugugugugucguugcaggccuuauucaagcuuaccaugaacuuucuauuaagcuggguacauuggucacuugcauuauuacuauauuuacaucacgcaaaauggagccaagcagcaccaauggcagaaggaggaggacaaaaccaucacgaaguaguaaaauuuauggauguauaucaaaggaguuacugccauccaauagaaacacuaguggacauauuccaagaauauccagaugaaauagaauauauauuuaaaccaagcuguguaccacuaaugagauguggaggaugcuguaacgaugaaggacuagaaugcguaccaacagaagaaagcaauauaacaaugcaaauaaugagaauaaaaccacaccaaggacaacacauaggagaaaugucauucuuacaacauaacaaaugcgaaugcagaccaaaaaaagaucgagcaagacaagaaaaaaaaucaguaagaggaaaaggaaaaggacaaaaaagaaaaagaaaaaaaagcagauacaaaaguuggagcguauacguaggagcaagauguugcuuaaugccauggucacuaccaggaccacacccaugcggacccuguagcgaaagaagaaaacaucuauucguacaagacccacaaacaugcaaaugcucaugcaaaaacacagacucaagauguaaagcaagacaacuagaacuaaaugaaagaacauguagaugugacaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4453 - RNA, 971 nt, Artificial Sequence
  mRNA product Design3 comprising derived and/or modified sequence from Homo sapiens__NP_003368.1__HsVEGFB (opt6)
gggagagucccgcagucggcguccagcggcucugcuuguucgugugugugucguugcaggccuuauucaagcuuaccaugucaccauuacuaagaagacuauuacuagcagcauuauuacaacuagcaccagcacaagcaccaguaucacaaccugaugcaccaggacaucaaagaaaaguaguaucauggauagauguauauacaagagcaacaugccaaccaagagaaguaguaguaccacuaacaguagaauuaaugggaacaguagcaaaacaauuaguacccucaugcguaacaguacaaagaugcggagguuguuguccagacgauggacuagaauguguaccuacaggucaacaucaaguaagaaugcaaauauuaaugauaagauacccaaguucacaauuaggagaaaugucauuagaagaacauucacaaugcgaauguagaccaaaaaaaaaagacucagcaguaaaaccagacagagcagcaacaccacaccauagaccucaaccaagaucuguaccaggaugggacucagcaccaggagcuccaucaccagcagacauaacucauccaacaccagcaccaggacccucagcacaugcagcuccaucaacuacaucagcauuaacaccaggaccagcagcagcugcugcagacgcagcagccucaucaguagcaaaaggaggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4454 - RNA, 1607 nt, Artificial Sequence
  mRNA product Design3 comprising derived and/or modified sequence from Homo sapiens__NP_005420.1__HsVEGFC (opt6)
gggagagucccgcagucggcguccagcggcucugcuuguucgugugugugucguugcaggccuuauucaagcuuaccaugcaccuauuaggauuuuucucaguagcauguucauuacuugcagcagcauuacuccccggaccaagagaagcaccagcugcagcagcagcauucgaaucaggacuagaccuaagcgaugcagaaccagacgcaggagaagcaacagcauaugcaaguaaagaccuagaagaacaauuaagaaguguaucaucaguagacgaacuaaugacaguacucuaccccgaauacuggaaaauguacaaaugccaauuaagaaaaggaggauggcaacacaacagagaacaagcuaaccuaaacucaagaacugaagaaacaauaaaauuugcagcagcccacuacaauacagaaauauuaaaaucaaucgauaacgaauggcgaaaaacacaauguaugccaagagaaguuuguauagacguaggaaaagaauuuggaguugcaacaaauacauuuuuuaaaccaccaugcgucucaguauacagaugcggaggaugcugcaauagcgaaggauuacaauguaugaauacaucaacaagcuacuuaagcaaaacacuauuugaaauaacaguacccuuaucacaaggacccaaaccaguuacaauaaguuuugcaaaucauacuucaugcagauguaugaguaaauuagauguuuaucgccaaguacauucaauaauacgacgcagucuaccagcaacauuaccacaaugccaagcugcaaauaaaacaugcccaacuaauuauauguggaauaaucacaucugcagaugucuugcacaagaagacuucauguuuuccucagaugcaggagacgauucaacagacggcuuccacgacauauguggaccaaauaaagaacuagaugaagaaacaugucaaugcgucugcagagcaggauuaagaccagcaucauguggaccacacaaagaauuagacaggaauuccugccaauguguauguaaaaauaaacuauuuccaucacaaugcggagccaaucgagaauucgacgaaaauacaugccaaugugucuguaaaagaaccugucccagaaaucaaccauuaaacccuggaaaaugugccugugaaugcacagagucaccacaaaaauguuuacuaaaaggaaaaaaauuccaucaucaaacaugcuccuguuacagaagacccugcacaaacagacaaaaagcaugcgaaccaggauucagcuacagugaagaaguaugcagauguguaccaucauauuggaaacgaccacaaaugucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4455 - RNA, 1412 nt, Artificial Sequence
  mRNA product Design3 comprising derived and/or modified sequence from Homo sapiens__NP_004460.1__HsVEGFD (opt6)
gggagagucccgcagucggcguccagcggcucugcuuguucgugugugugucguugcaggccuuauucaagcuuaccauguacagagaauggguaguaguaaacguauucaugaugcuauacguacaauuaguacaagguuccucaaacgaacacggcccaguaaaaagaucaucccaaagcacacuagaaagaucugaacaacaaauaagagcagcaucuucacuagaagaacuuuuaagaauaacacacucagaagacuggaaacuauggagaugcagacuaagacuaaaaucauucacaucuauggacagcagguccgcaagucacagaucaaccagauucgccgcaacauuuuaugacauagaaacacucaaaguaauagacgaagaauggcaaagaacacaaugcaguccaagagaaacauguguagaaguagccucagaacuaggaaaaagcacuaacacauucuucaaaccaccaugcguaaauguauucagaugcggcggauguugcaacgaagaaucucucauauguaugaacacaaguacaucauacaucucaaaacaacuauucgaaauaucagucccauuaacaucaguaccagaacuaguaccaguaaaaguagcaaaccacacaggauguaaaugccuaccaacagcaccaagacacccauacaguaucauaagaagaucaauccaaauaccagaagaagaccgaugcucccacucaaaaaaauuaugcccaauagacaugcuaugggauucaaacaaaugcaaaugcguacuacaagaagaaaacccauuagcaggaacagaagaccacucucacuuacaagaaccagcauuaugcggaccacauaugauguucgacgaagauagaugugaauguguaugcaaaacuccaugcccaaaagaccuaauacaacacccaaaaaacugcucauguuucgaaugcaaagaaucucuagaaacaugcugccaaaaacacaaauuauuucacccagacacaugcucaugcgaagacagaugcccuuuccacaccagaccaugugccagcggaaaaacagcaugugcaaaacacuguagauuuccaaaagaaaaacgagcagcccaaggaccacacucaagaaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4456 - RNA, 977 nt, Artificial Sequence
  mRNA product Design3 comprising derived and/or modified sequence from Homo sapiens__NP_061986.1__HsFGF21 (opt7)
gggagagucccgcagucggcguccagcggcucugcuuguucgugugugugucguugcaggccuuauucaagcuuaccauggacagcgaugagaccggcuucgaacacuccgggcugugggugaguguccucgccggucuguugcugggcgcaugccaggcccaucccaucccagacagcuccccgcuccugcaauuugggggccaggugaggcagcgguacuuguauacugaugacgcgcagcaaaccgaggcccaccuggaaauucgcgaggaugguacgguagggggcgcagccgaccagagucccgaaagccuccugcagcugaaggcacucaaaccaggcgugauccagauucugggggucaagacuuccagguucuugugucaacggcccgauggugcccuguacggcagccuccauuuugacccagaggcgugcuccuuccgcgagcugcuguuggaagauggguauaacguguaccagagugaggcccacggccucccccugcaucugccagguaauaaaagcccgcacagggaccccgcaccacgggggcccgcccgcuuucucccacugcccggcuugccgcccgcccugccagaacccccaggcauccucgcaccccagccaccggaugugggguccagcgacccccugaguauggucgguccaucccagggcaggagccccuccuaugccaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4457 - RNA, 1757 nt, Artificial Sequence
  mRNA product Design3 comprising derived and/or modified sequence from Homo sapiens__NP_002412.1__HsMMP1 (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucccggccacccucgagacucaggaacaagacguggaucugguacagaaguacuuggagaaauauuacaaccugaagaaugacgggaggcaaguggaaaaacggcgcaacagcggucccgucguggagaagcucaaacagaugcaggaauuuuucggccugaaggugaccgggaagccagaugcagagacgcugaaagucaugaagcagcccaggugcggcgugccagacguagcccaguuugugcucacugaggguaauccccggugggaacagacccaccugaccuaucgcaucgagaacuacacuccagauuugccgagggcggacgucgaucaugccauugaaaaagcauuccaacugugguccaaugugacgccccucaccuuuacuaaggugagugaggggcaggccgacaucaugauuagcuucguccggggcgaucaccgcgacaacuccccauuugauggccccggggguaaucuggcacaugccuuccagccaggccccgggaucggcggugacgcgcacuuugaugaggacgaaagguggaccaacaauuuccgggaguauaaccugcaccgcguggccgcacaugaauuggggcacagccucggccugucccauaguacugacauuggcgcccugauguacccgagcuauaccuucuccggggauguacagcucgcccaagacgauaucgacgguauccaggcaauuuacggcaggagccagaaucccgugcaaccaaucgggccccagaccccaaaagccugugauaguaagcugacguuugacgcgauuacuaccauccggggcgaggucauguucuuuaaagaucgcuucuacaugaggacuaaccccuuuuauccagaaguggaguugaauuucauuuccguguuuuggccgcagcugcccaacggucucgaggccgcauacgaguucgccgaccgggaugaaguccgcuuuuucaagggcaauaaguauugggcagugcaggggcaaaacguacugcacggcuacccaaaagacaucuauagcuccuuuggguuccccaggaccgugaagcacauugaugccgcccugagugaagagaacaccgguaaaacuuacuuuuucgucgcgaauaaguauuggcgguacgacgaauacaaacgcagcauggacccaggcuaucccaagaugaucgcacaugauuucccggggaucggccacaagguggacgccgucuuuaugaaagaugguuucuuuuacuucuuucauggcacgaggcaguauaaguucgacccaaaaaccaagcggauuuugacucuccagaaagccaacuccugguuuaauugcaggaagaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4458 - RNA, 1517 nt, Artificial Sequence
  mRNA product Design3 comprising derived and/or modified sequence from Homo sapiens__NP_002412.1__HsMMP1(1-19,100-469) (opt7)
gggagagucccgcagucggcguccagcggcucugcuuguucgugugugugucguugcaggccuuauucaagcuuaccaugcacagcuuucccccacugcuccuguugcuguucuggggcguggucucccauaguuucgugcucaccgaggggaacccgaggugggaacagacucaccugaccuaccggaucgagaauuauacgcccgacuugccacgcgccgauguagaccaugcaauugaaaaggccuuucaacuguggagcaacgugacuccccucaccuucaccaaagucuccgagggucaggcggauaucaugauuaguuuugugaggggcgaccaccgggauaauagcccauucgacgggcccggcgguaaccuggcccaugcauuucagccagggccgggcaucggcggggaugcccacuucgacgaagaugagcgcuggacuaauaacuuuagggaguacaaucugcaccggguggcagcccaugaacucggucacucccugggcuugagccauuccaccgacauuggggcgcugauguaucccaguuacacguucagcggcgauguccagcucgcccaagacgauaucgacgguauccaggcaauuuaugggcgcucccagaacccagugcagcccaucggcccacaaacucccaaggccugcgacagcaaacugaccuuugaugccauuacuaccaucaggggcgagguaauguucuucaaggaccgguuuuacaugcgcaccaauccguucuaucccgaaguggagcugaacuuuauuagugucuucuggccacaguugcccaaugggcucgaggcagccuacgaauuugcggauagggacgaggugcgguucuuuaaagguaacaaguacugggccgugcagggccagaauguccugcacggguauccaaaggauaucuacuccagcuucggcuuuccccgcacggugaaacacauugacgcagcccuguccgaagagaacacugguaagaccuauuucuuuguagcaaauaaauacuggagguaugaugaauacaagcggaguauggacccaggcuauccgaaaaugaucgcccaugauuuccccgggaucggccacaagguggacgccgucuuuaugaaagauggguucuucuacuuuuuccaugguacucgccaauacaaguuugacccaaagaccaaaaggauucucacccugcagaaggcgaacagcugguucaacugucggaaaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4459 - RNA, 3704 nt, Artificial Sequence
  mRNA product Design3 comprising derived and/or modified sequence from Clostridium histolyticum__BAA77453.1__ColG (opt7)
gggagagucccgcagucggcguccagcggcucugcuuguucgugugugugucguugcaggccuuauucaagcuuaccaugaagaaaaacauccugaagauucucauggacagcuacuccaaagagaguaagauccagaccgugaggcgggucacuagcgugucccuguuggccguauaucugaccaugaauacgaguagccucgugcuggcaaaacccauugaaaacacuaaugauaccuccaucaagaacgucgagaaguugcgcaaugccccaaacgaagagaauagcaaaaagguggaagacuccaaaaacgauaagguggagcacgucaaaaauauugaggaagcgaagguggagcaaguagccccggaagugaaaaguaagagcacccugagguccgcaagcaucgccaacacuaauagugagaaguacgacuucgaguaucucaacggccuguccuacaccgaacugacgaaucucaucaaaaacauuaaguggaaucagaucaacgggcuguuuaacuauagcacugguucccagaaauucuuuggcgauaagaaucggguccaggcaauuaucaacgccuugcaagagagugggcgcaccuacacugcgaaugacaugaaaggcauugaaaccuucaccgaggugcugagggccgguuuuuaucucggguacuacaacgauggccugagcuaucugaaugaccggaacuuccaggauaagugcauccccgcaaugauugccauccagaagaauccaaacuuuaaauugggcacggccgugcaggacgaagucaucacuucccucgggaagcugauugguaaugcaagcgccaacgcggaggugguaaauaacugugugcccguccugaaacaauuccgcgagaaucucaaccaguacgccccagauuaugugaagggcaccgcagugaaugaacugaucaaagggauugaguuugacuucaguggcgccgcauacgaaaaggaugucaagacuaugcccugguaugguaaaaucgacccauuuauuaacgaguugaaggcccuggggcucuacggcaacaucaccuccgccaccgaaugggcgagcgacgugggcaucuauuaccugaguaaauucgggcuguacuccacuaauaggaacgauauuguacagagcuuggagaaggcaguggacauguauaaauacgguaagaucgccuucgucgccauggagcggauuacgugggauuaugacggcaucgggagcaauggcaagaaaguggaucaugacaaguuucucgaugacgcagaaaaacacuaccugccgaagaccuauacuuucgauaacgguaccuuuauuauccgcgccggcgacaaagucuccgaggaaaagaucaaaaggcuguacugggcgagucgggagguaaagagccaguuccaucgcgugguggggaaugauaaggcccucgaagugggcaacgcagacgacguccugaccaugaaaauuuuuaauucccccgaggaguauaaguucaacacuaauaucaacggggugagcacggauaaugguggcuuguacauugaaccaagggggaccuuuuacacuuaugagcggacuccccaacagaguaucuucucccuggaggaacucuuucgccacgaguacacccauuaucugcaggccagguaccuggucgacggcuuguggggucaaggcccauucuaugagaaaaaccggcucaccugguuugaugaagggacggcagaguucuuugccggcagcacccgcacuuccggggugcugcccaggaagaguauucugggcuaccucgccaaagacaagguggaucaccgguauagccugaagaaaaccuugaacuccgguuacgacgauagcgacuggauguucuacaauuauggguucgcaguagcccacuaccuguaugaaaaggauaugccgacuuuuaucaaaaugaauaaggcgauucucaacaccgacgugaaaaguuacgaugaaaucaucaagaagcuguccgacgaugccaacaaaaauacggaguaucagaaccauauucaggagcuggcagacaaguaccagggcgccgguauccccuuggucagcgacgauuaucugaaagaccacggcuacaagaaagccuccgaaguguacagugagauuagcaaggcagcgucccucaccaauacuagcgucaccgccgagaaaagucaauauuucaacacuuuuacccugagggggacguacaccggcgaaacuuccaagggggaguucaaggauugggacgaaaugagcaaaaagcucgauggcacccuggaguccuuggccaaaaauagcuggagugguuauaagacucugaccgcauacuuuacgaacuaucgcgugaccagcgacaauaaagugcaguacgauguagucuuccauggggugcucacugacaacgccgauaucuccaauaacaaggcaccaauugccaaggugaccggccccaguacuggcgcggucgggcggaauaucgaauuuagcgguaaagacuccaaggaugaggacggcaaaaucgugagcuacgacugggauuucggggacggcgccaccuccagggguaagaacagugugcacgcauauaaaaaggccgggacguacaauguaacccugaaggucacugaugacaaaggcgccaccgcaacugagagcuuuaccauugaaaucaagaacgaagauacuaccacgccaauuaccaaagagauggagcccaaugacgauaucaaggaagccaacggcccaauuguggagggggugacugucaaaggugaccugaacggcuccgaugacgcggauaccuucuauuuugacgugaaggaagauggggacguaacuaucgaguugccguacaguggcagcuccaauuucaccuggcugguguauaaagagggugacgaucagaaccacaucgccagcgggauugacaagaauaacaguaaggucggcacguucaaauccaccaagggccgccauuacguguuuaucuauaaacacgauagcgcauccaauauuagcuacagucucaacaucaaggggcuggguaaugaaaaacucaaggagaaggaaaacaaugacuccagcgauaaagccacugugauucccaacuucaauaccacuaugcagggcagucuguugggggacgauucccgggacuacuauagcuuugaggucaaggaagagggcgaggugaacaucgaacuggauaaaaaggacgaguucgguguaaccuggacgcugcauccagaauccaauauuaacgauaggaucaccuacgggcaaguggacggcaauaaagucagcaacaaggugaagcuccgccccggcaaauauuaccuguugguguauaaguacagugggagcgguaacuaugagcugcgggucaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4460 - RNA, 3428 nt, Artificial Sequence
  mRNA product Design3 comprising derived and/or modified sequence from Clostridium histolyticum__BAA77453.1__HsALB(1-18)_ColG(111-1118) (opt7)
gggagagucccgcagucggcguccagcggcucugcuuguucgugugugugucguugcaggccuuauucaagcuuaccaugaagugggugaccuucaucagccugcucuuucuguucuccagugccuacagcauugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4461 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4462 - RNA, 3452 nt, Artificial Sequence
  mRNA product Design3 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaacuuccugaagaucauucucaauaggggcaaaaccaugaagcggaaaugccugagcaagcgcuugaugcuggccaucacuauggcaaccauuuuuacggugaacuccacucuccccaucuacgccgcggucgacaaaaauaacgccaccgcagccgugcagaaugagaguaagagguauaccguaagcuaccugaagacuuugaacuauuacgaucugguggaccuccuggucaaaaccgaaauugagaaucugccagaucucuuccaauauuccagugacgcaaaggaauuuuacgggaacaaaacgcggaugagcuucaucauggaugagaucggucgcagggccccgcaguauacugaaauugaccacaagggcauccccacccugguggaggugguccgggcgggguuuuacuugggcuuccauaauaaagagcugaacgaaauuaauaagcgcuccuuuaaagagagggugaucccaagcauucucgccauccagaagaaccccaauuucaagcuggguacugaaguacaggauaaaauuguguccgcaaccgggcuguuggccggcaacgagaccgccccacccgaggucgugaauaacuuuacgccaauccuccaagacuguaucaagaacauugaucgguacgcacuggacgaucugaaaaguaaggcccucuucaaugugcuggcggccccgacuuaugacaucaccgaauacuugcgcgcaacuaaagagaagcccgaaaacaccccaugguauggcaagauugauggguuuaucaaugagcugaaaaagcucgcccuguacgguaaaauuaacgacaauaacagcuggaucaucgacaauggcauuuaucacaucgcaccccuggggaaguugcauuccaacaauaaaauuggcaucgaaacccucacugaggucaugaagguguacccauaucugagcaugcagcaucugcagagugccgaucagauuaagaggcacuacgacuccaaagaugccgaggguaacaagaucccccucgacaaauucaagaaagaagggaaggagaaguacugcccgaaaacguauaccuucgaugacggcaagguaaucauuaaagcgggcgcacggguggaagaggaaaaggucaaacgccuguacugggccagcaaggaggugaauagucaauuuuucaggguguaugggaucgauaaacccuuggaggaagguaacccagacgauauucugacuauggucaucuacaauagucccgaggaauauaagcucaacagcgugcuguacggcuaugacaccaauaacgggggcauguacauugagccagaagguaccuuuuucacuuacgagcgggaggcccaggaauccacguauacccuggaggaauuguuucgccacgaguacacucacuaucuccagggcagguacgcaguacccgggcaguggggccggaccaagcuguaugauaacgaccgccugaccugguacgaggaagggggugccgaacucuucgcgggcagcacuaggacgagugggauccugccacggaaauccauugugagcaauauccauaacaccacuaggaauaaccgcuauaaguugagugacaccguccacuccaaauacggcgccagcuuugaguucuacaauuaugcauguauguuuauggauuacauguauaacaaggacauggguauccugaauaaacucaacgaucuggccaagaauaacgacguggauggcuacgacaauuauauucgggaucugagcuccaacuacgcauugaaugacaaguaucaagaucauaugcaggagaggaucgacaacuacgaaaaucugacugucccguucguggccgaugacuaccucgugcgccacgccuauaaaaaccccaacgagauuuacagugagaucagcgaaguagcaaagcugaaagaugccaaguccgaggugaaaaagagccaguauuuuaguaccuucacgcuccggggguccuacaccggcggggcgagcaagggcaaacuggaagaccaaaaggccaugaauaaauuuauugacgauuccuugaagaaacuggacacuuauaguuggagcgguuacaagacccucacugcauacuucaccaacuauaaagucgauuccagcaauagggugacguacgacgucguguuccacggguaucugccaaacgagggcgauaguaaaaauucccugcccuacgguaagaucaacggcaccuauaaggggacugaaaaggagaaaaucaaguuuagcuccgagggcaguuucgacccagaugggaaaauugugagcuacgaaugggacuuuggcgaugguaauaaguccaacgaggaaaaucccgagcauagcuaugacaagguagggaccuacacugugaaauugaaggucaccgaugacaaaggcgaaaguuccgugagcacgaccacugccgagaucaaggaccuguccgagaacaaacucccggucauuuacaugcacgugccaaagagcggcgcccugaaucagaaggugguauucuaugggaaagguaccuacgaucccgacggcaguaucgcaggguaucagugggauuuuggcgacgguagcgauuucuccagugaacagaaccccagccaugucuacacuaagaaaggggaguauaccgugacgcuccgcgugauggacuccagcggccaaauguccgaaaagaccaugaaaauuaagaucacugauccagucuaccccaucggcaccgagaaagagccaaauaacaguaaggaaacugcgagcgggccgauugugcccgguaucccaguguccggcaccauugagaauacuuccgaccaggauuauuuuuacuucgacguaaucacccccggggaagucaagauugauaucaacaaacugggcuacgguggggccacgugggugguguaugacgagaacaauaacgcagucagcuacgccaccgaugacggccagaauuuguccggcaaguuuaaagccgacaagccagggcgguauuacauucaccuguauauguucaacgguagcuacaugcccuauaggaucaauaucgaaggcaguguggggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4463 - RNA, 3413 nt, Artificial Sequence
  mRNA product Design3 comprising derived and/or modified sequence from Clostridium histolyticum__BAA34542.1__ColH (opt7)
gggagagucccgcagucggcguccagcggcucugcuuguucgugugugugucguugcaggccuuauucaagcuuaccaugaagaggaaaugccugagcaagcggcucaugcuggccaucaccauggcaacuauuuucaccgugaacuccacguugcccaucuacgccgcggucgacaaaaauaacgccacugcagccgugcagaaugagaguaagcgcuauaccguaagcuaccugaaaacccucaacuauuacgaucugguggacuugcuggucaagacugaaauugagaaucucccagaucuguuucaauauuccagugacgcaaaggaguucuacggcaacaaaaccaggaugagcuuuaucauggaugaaauugggcggcgcgccccgcaguauacggaaaucgaccacaaggguauccccacucugguggagguggucagggcgggcuucuaccucggguuucauaauaaagagcugaacgaaauuaauaagcgguccuucaaagagcgcgugaucccaagcauuuuggccauccagaagaaccccaauuuuaaacugggcaccgaaguacaggauaagauuguguccgcaacuggucuccuggccgggaacgagaccgccccacccgaggucgugaauaacuucaccccaauccugcaagacuguauuaagaauaucgauagguacgcauuggacgaucucaaaaguaaggcccuguuuaacgugcuggcggccccgacguaugacaucacugaauaccuccgggcaaccaaagagaagcccgaaaacacuccaugguauggcaaaauugauggcuucaucaaugagcugaagaaguuggcccuguacgggaaaauuaacgacaauaacagcuggaucauugacaaugguaucuaucacaucgcaccccucggcaagcugcauuccaacaauaaaauugggaucgaaacccugaccgaggucaugaagguguacccauauuugagcaugcagcaccuccagagugccgaucagauuaaacgccauuacgacuccaaggaugccgagggcaacaagaucccccuggacaaauuuaagaaagaagguaaggagaaauacugcccgaagacuuauacguucgaugacgggaagguaauuaucaaagcgggcgcaaggguggaagaggaaaaggucaaacggcuguacugggccagcaaggaggugaauagucaauucuuucgcguguauggcaucgauaaaccccucgaggaagggaacccagacgauauucugaccauggucaucuacaauagucccgaggaauauaaguugaacagcgugcuguacgguuaugacacuaauaacggcgggauguacauugagccagaaggcaccuucuuuaccuacgagagggaggcccaggaauccacuuauacgcucgaggaacuguuccggcacgaguacacccacuaucugcagggucgcuacgcaguacccggccagugggggaggacuaaauuguaugauaaugaccggcucaccugguacgaggaaggcggggccgagcuguuugcggguagcacccgcacuuccggcauccugccaaggaaguccauugugagcaacauccauaacacgacccggaauaacagguauaagcucagugacacuguccacuccaaauacggggccagcuucgaauuuuacaauuaugcauguauguucauggauuacauguauaacaaggacaugggcauucugaauaaauugaacgaucuggccaagaauaacgacguggaugguuacgacaauuauauccgcgaucucagcuccaacuacgcacugaaugacaaauaucaagaucauaugcaggagcggaucgacaacuacgaaaaucugaccgucccguuuguggccgaugacuacuuggugaggcacgccuauaagaaccccaaugagauuuacagugagaucagcgaaguagcaaagcugaaagaugccaaguccgaggugaaaaagagccaguauuucaguacuuuuacccuccgcggcuccuacacgggcggcgcgagcaaagggaagcuggaagaccaaaaggccaugaacaaauucauugacgauucccucaagaaacuggacaccuauaguuggagcggcuacaagacuuugaccgcauacuuuacuaacuauaaagucgauuccagcaaucgggugaccuacgacgucguguuccacgguuaucugccaaacgagggggauaguaaaaauucccuccccuacggcaagaucaacgguacguauaagggcaccgaaaaggagaaaauuaaguucagcuccgaggggaguuuugacccagauggcaaaaucgugagcuacgaaugggacuucggggauggcaauaaguccaacgaggaaaaucccgagcauagcuaugacaaaguagguacuuacaccgugaagcugaaggucacugaugacaaaggggaaaguuccgugagcaccacgaccgccgagaucaaggaccuguccgagaacaaauugccggucauuuacaugcacgugccaaagagcggcgcccugaaucagaaagugguauuuuauggcaaggggacuuacgaucccgacgguaguaucgcaggcuaucagugggauuucggggacggcagcgauuuuuccagugaacagaaccccagccaugucuacaccaagaaaggugaguauacugugacccucagggugauggacuccagcgggcaaauguccgaaaagacgaugaaaauuaagaucaccgauccagucuaccccauuggcacugagaaagagccaaauaacaguaaggaaaccgcgagcggcccgaucgugcccgggaucccaguguccgguacuauugagaauaccagugaccaggauuauuucuacuuugacguaaucacucccggcgaagucaaaauugauaucaacaagcugggguacggcggugccaccugggugguguaugacgagaauaacaacgcagucagcuacgccacggaugacgggcagaaucucuccggcaaguucaaagccgacaagccaggccgcuauuacauucaccuguauauguuuaacgggagcuacaugcccuaucggaucaauauugaagguaguguggggaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4464 - RNA, 3347 nt, Artificial Sequence
  mRNA product Design3 comprising derived and/or modified sequence from Clostridium histolyticum__BAA34542.1__HsALB(1-18)_ColH(41-1021) (opt7)
gggagagucccgcagucggcguccagcggcucugcuuguucgugugugugucguugcaggccuuauucaagcuuaccaugaagugggugaccuucaucagccugcucuuucuguucuccagugccuacagcguccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4465 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt7)
gggagagucccgcagucggcguccagcggcucugcuuguucgugugugugucguugcaggccuuauucaagcuuaccaugaagugggugaccuucaucagccugcucuuucuguucuccagugccuacagcaugaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4466 - RNA, 923 nt, Artificial Sequence
  mRNA product Design3 comprising derived and/or modified sequence from Homo sapiens__NP_001133.1__HsAMELX (opt7)
gggagagucccgcagucggcguccagcggcucugcuuguucgugugugugucguugcaggccuuauucaagcuuaccaugggcaccuggauccuguucgccugccuccugggggcagccuuugcgaugcccuugccaccgcaccccggucauccaggcuacauuaacuucagcuaugaggugcugacuccccucaagugguaccaguccaucaggccacccuauccaaguuacggguaugaaccgaugggcgguuggcugcaccaucaaauuauccccgucuugagccagcagcacccacccacccauacgcugcagccacaccaccauauucccgugguaccggcccaacagcccgugaucccacagcagcccaugaugccaguccccgggcaacacuccaugacuccaauccagcaucaccagccgaaucugcccccacccgcacagcaaccauaccagccccagccggugcaaccacagccccaccagcccaugcagccacaacccccagugcauccgaugcagccccucccaccccagccaccccugccgccaauguuucccaugcagccacugcccccgaugcuccccgacuugacccuggaggccuggccaaguaccgauaaaacuaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4467 - RNA, 482 nt, Artificial Sequence
  mRNA product Design3 comprising derived and/or modified sequence from Homo sapiens__NP_001133.1__HsAMELX-TRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucaccccacugaagugguaccaguccauuaggccacccuaucccaguuacgguuaugaaccgaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4468 - RNA, 515 nt, Artificial Sequence
  mRNA product Design3 comprising derived and/or modified sequence from Homo sapiens__NP_001133.1__HsAMELX-LRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccaguccauuaggccacccccaauguugccggaccugacccucgaagccuggcccaguaccgauaaaacgaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4469 - RNA, 554 nt, Artificial Sequence
  mRNA product Design3 comprising derived and/or modified sequence from Homo sapiens__NP_001133.1__HLA-A2-SP_HsAMELX(17-60) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccauauccgagcuacggcuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4470 - RNA, 587 nt, Artificial Sequence
  mRNA product Design3 comprising derived and/or modified sequence from Homo sapiens__NP_001133.1__HLA-A2-SP_HsAMELX(17-47,168-191) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguauucggcccccaccgaugcuccccgaccugacucuggaagcauggccaagcaccgauaaaaccaagcgcgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4471 - RNA, 926 nt, Artificial Sequence
  mRNA product Design3 comprising derived and/or modified sequence from Homo sapiens__NP_001134.1__HsAMELY (opt7)
gggagagucccgcagucggcguccagcggcucugcuuguucgugugugugucguugcaggccuuauucaagcuuaccaugggcaccuggauccuguucgccugccucgugggggcagccuuugcgaugccccugccaccgcaccccggucauccaggcuacauuaacuucagcuaugaggucuugacuccccugaagugguaccaguccaugaucaggccacccuauaguagcuacggguaugaaccaaugggcgguuggcuccaccaucaaauuaucccggugguaucccagcagcacccccugacccauacguugcagagucaccaccauauuccagugguccccgcccaacagccacgggugcgccagcaggcacugaugcccgugccggggcaacagagcaugacucccacccagcaccaucagccaaaucucccccugccagcccaacagcccuuucagccacaaccgguccagccccagccacaccagcccaugcaaccacagcccccggugcagccaaugcagccccugcucccccaaccaccccugccaccgauguuccccuugaggccacugcccccaauccuccccgaccugcaccuggaggcauggccggccaccgauaaaacuaagcaggaagagguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4472 - RNA, 485 nt, Artificial Sequence
  mRNA product Design3 comprising derived and/or modified sequence from Homo sapiens__NP_001134.1__HsAMELY-TRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucaccccacugaagugguaccaguccaugauuaggccacccuauaguagcuacgguuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4473 - RNA, 518 nt, Artificial Sequence
  mRNA product Design3 comprising derived and/or modified sequence from Homo sapiens__NP_001134.1__HsAMELY-LRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccaguccaugauuaggccacccccaaucuugccggaccugcaccucgaagccuggcccgcaaccgauaaaaccaagcaagaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4474 - RNA, 557 nt, Artificial Sequence
  mRNA product Design3 comprising derived and/or modified sequence from Homo sapiens__NP_001134.1__HLA-A2-SP_HsAMELY(17-61) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccauauagcuccuacggcuaugaaccgaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4475 - RNA, 590 nt, Artificial Sequence
  mRNA product Design3 comprising derived and/or modified sequence from Homo sapiens__NP_001134.1__HLA-A2-SP_HsAMELY(17-48,169-192) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaguaugauucggcccccaccgauccuccccgaccugcaccuggaagcauggccagccacugauaaaaccaagcaggaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4476 - RNA, 917 nt, Artificial Sequence
  mRNA product Design3 comprising derived and/or modified sequence from Sus scrofa__NP_999071.1__SsAMELX-001-1 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4477 - RNA, 485 nt, Artificial Sequence
  mRNA product Design3 comprising derived and/or modified sequence from Sus scrofa__NP_999071.1__SsAMELX-TRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccagaauaugauuaggcacccauauaccuccuacgguuaugaacccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4478 - RNA, 518 nt, Artificial Sequence
  mRNA product Design3 comprising derived and/or modified sequence from Sus scrofa__NP_999071.1__SsAMELX-LRAP (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccagaauaugauuaggcacccauccuugcugcccgaccucccacuggaagccuggccggcaaccgauaaaaccaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4479 - RNA, 557 nt, Artificial Sequence
  mRNA product Design3 comprising derived and/or modified sequence from Sus scrofa__NP_999071.1__HLA-A2-SP_SsAMEL(17-61) (opt7)
gggagagucccgcagucggcguccagcggcucugcuuguucgugugugugucguugcaggccuuauucaagcuuaccauggccgugauggcacccaggacucugguccuccuguugagcggcgcccuggcgcucacucagaccugggccaugccacugccgccccacccagggcaucccgguuacaucaacuucuccuaugagguguugacgccacugaagugguaccaaaauaugauucggcaccccuauaccaguuacggcuaugaaccaaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4480 - RNA, 590 nt, Artificial Sequence
  mRNA product Design3 comprising derived and/or modified sequence from Sus scrofa__NP_999071.1__HLA-A2-SP_SsAMEL(17-49,167-189) (opt7)
gggagagucccgcagucggcguccagcggcucugcuuguucgugugugugucguugcaggccuuauucaagcuuaccauggccgugauggcacccaggacccugguccuccuguugagcggcgcccuggcgcucacucagaccugggccaugccacugccgccccacccagggcaucccgguuacaucaacuucuccuaugagguguugacgccacugaagugguaccaaaauaugauucggcaccccagucuccugccagaccugccgcucgaagcauggcccgccacugauaaaaccaagcgcgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4481 - RNA, 881 nt, Artificial Sequence
  mRNA product Design3 comprising derived and/or modified sequence from Sus scrofa__P45561-2__SsAMELX-001-2 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuauaucaggcaccccuacaccaguuauggguacgagccaaugggcgguuggcugcaucaccagauuauccccguggucagccaacagacuccacagucccaugcgcuccagccgcaccaccauauucccauggugccagcccaacagcccgggaucccacagcagcccaugaugccgcugcccggccaacacaguaugacgccaacucagcaucaccagcccaauuugccacugcccgcacagcaaccauuucagccgcagcccguacaaccacagccccaccagccacuccagccccaaagcccgaugcauccaauccagccccugcugccccagccaccccucccaccgauguucuccaugcagagccuguugcccgaccugccacucgaagccuggcccgcaaccgauaagaccaaacgggaggaaguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4482 - RNA, 917 nt, Artificial Sequence
  mRNA product Design3 comprising derived and/or modified sequence from Sus scrofa__NP_998965.1__SsAMELX-001-3 (opt7)
gggagagucccgcagucggcguccagcggcucugcuuguucgugugugugucguugcaggccuuauucaagcuuaccaugggcaccuggaucuucuuugccugccugcucggggcaagccuggccaugcccuugccaccgcaccccggucauccaggcuacauuaacuucuccuaugaggugcugacuccccucaagugguaccagaauaugaucaggcacccauauaccaguuacggguaugaacccaugggcgguuggcugcaucaccaaauuaucccagucgugagccagcagacgccgcagucccaugcguugcaaccccaccaccauauuccaaugguacccgcccagcagccagggaucccccagcaaccgaugaugccccugccaggccagcacaguaugacucccacccagcaucaccagccaaaccucccccugccagcacaacagccguuucagccccaaccagugcagccccagccacaccagccccugcaaccgcagagcccaaugcaucccauccagccccuccugccacagcccccauugccgcccauguucuccaugcaaagccugcucccagaccugccccuggaggccuggccagcaaccgauaaaacuaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4483 - RNA, 566 nt, Artificial Sequence
  mRNA product Design3 comprising derived and/or modified sequence from Sus scrofa__K7GPB2__SsAMELX-002 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaagucuguugcccgaccugccacucgaagcguggccggccaccgauaaaacgaagcgggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4484 - RNA, 959 nt, Artificial Sequence
  mRNA product Design3 comprising derived and/or modified sequence from Sus scrofa__K7GLD0__SsAMELX-003 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggaccuguaccucgaagcgaucaggauugaucggacugccuuugugcugacccccuugaagugguaucagaauaugauccgccacccauacacgaguuauggguacgagcccaugggcgguuggcugcaucaccaaauuaucccagucgugagccagcagacuccgcagucccaugcacuccaaccccaccaccauaucccaaugguacccgcccagcagccagggauuccccagcaaccgaugaugccccugccaggccagcacaguaugacccccacccagcaucaccagccaaaccugccccucccagcacaacagccguuccagccccaaccagugcagccccagccacaccagccccugcaaccgcagagcccaaugcaucccauccagcccuugcugccacagcccccacucccgcccauguuuuccaugcaaagccugcugccagacuugccccucgaagccuggccagcgacugauaaaaccaagagggaggaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4485 - RNA, 845 nt, Artificial Sequence
  mRNA product Design3 comprising derived and/or modified sequence from Sus scrofa__K7GPE9__SsAMELX-004 (opt7)
gggagagucccgcagucggcguccagcggcucugcuuguucgugugugugucguugcaggccuuauucaagcuuaccaugggcaccuggauccuguucgccugccuccugggggcagccuuuagcaugcccuugccaccgcaccccggucauccaggcuacauuaacuucuccuaugaggugcugacuccccucaagugguaccagaauaugaucaggcacccaacgccccaaagucaugcgcugcagccacaccaucacauuccgaugguccccgcccagcagccagggaucccccaacagccaaugaugcccuugccgggccagcacagcaugacccccacucagcaucaccaaccaaaccugccccucccagcacagcagcccuuucagccacaaccggugcagccccagccacaucaaccccugcagccacagucccccaugcacccgauucagccacugcucccccaacccccacugcccccaauguucaguaugcagagcuugcugccggaccucccccuggaagccuggccagcaaccgauaaaaccaagcgggaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4486 - RNA, 869 nt, Artificial Sequence
  mRNA product Design3 comprising derived and/or modified sequence from Sus scrofa__J9JIM4__SsAMELX-201 (opt7)
gggagagucccgcagucggcguccagcggcucugcuuguucgugugugugucguugcaggccuuauucaagcuuaccaugccccugccaccgcaccccggccauccaggguacaucaacuucagcuaugaggugcucacuccccugaagugguaccagaauaugauuaggcacccauauaccuccuacgguuaugaacccaugggcgggugguugcaucaccaaaucauuccagucgugagucagcagaccccgcagagccaugcccugcaaccccaccaccauaucccaaugguacccgcacagcagccaggcauuccccagcaaccgaugaugccccucccaggucagcacuccaugacgcccacucagcaucaccagccaaaccugcccuugccagcccaacagccguuucagccccaaccagugcagccccagccacaccagccccugcaaccgcagaguccaaugcaucccauccagccccuccugccacagcccccacugccgcccauguucagcaugcaaucccuccugccagacuugccccuggaggcguggccagccaccgauaaaaccaagcgggaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4487 - RNA, 3308 nt, Artificial Sequence
  mRNA product Design3 comprising derived and/or modified sequence from Homo sapiens__NP_006120.1__HsBMP1 (opt7)
gggagagucccgcagucggcguccagcggcucugcuuguucgugugugugucguugcaggccuuauucaagcuuaccaugcccggcguggccaggcugccacuccuguuggggcugcuccuguugccgcggcccggucgcccacuggaccucgcagauuacaccuaugaccuggccgaggaagaugacagcgagccccugaacuacaaggauccaugcaaagcggccgcauuccucggcgacaucgcccuggaugaagaggacuugagggcauuucagguccaacaggccguggaucugcggcgccacacugcgaggaaguccaguauuaaagccgcaguacccgggaauaccagcacgccauccugucagaguacuaacggccagccgcaacggggugccugcgggcgcuggaggggccggagccgcuccaggcgggccgcaaccagccgccccgaaaggguguggccagacggcgucauccccuucgugauuggggguaauuuuaccggcucccagcgggccguguuccgccaggcgaugaggcauugggagaagcacacuugugucaccuuucucgagcggacggaugaagacaguuauaucguguucacuuaccgcccaugcggguguugcagcuauguaggcaggcggggugggggcccccaggccauuuccaucggcaaaaacugugauaaguuugggaucgugguccaugagcugggucacguggugggcuucuggcaugaacacaccaggccggaccgcgaccggcacgucagcauugugagggagaauauccaacccgggcaggaguacaacuuucugaagauggaaccacaggagguagaaaguuugggcgagacuuaugauuucgacuccauuaugcauuacgcacgcaauaccuuuagccgggguaucuuccucgauaccauugugcccaaauacgaagucaacggcgugaagccacccaucgggcagaggacgcgccuguccaaaggcgacauugcccaagcacggaagcuguauaaaugcccagccuguggggagacucuccaggauaguaccgguaauuucagcuccccggaguaccccaacggcuauagcgcccacaugcauugcguguggaggaucagugucacuccaggggaaaagaucauucugaauuuuaccuccuuggaccuguaccggagccgccucugcugguaugauuacguggagguaagggacggcuucuggcggaaagcgccccugcgcgguagguuuuguggcaguaagcugccagaacccaucguguccaccgauagccgguugugggucgaguuccgcagcuccaguaacuggguggggaagggcuuuuucgcagucuaugaagccauuugcgggggcgacgugaaaaaggauuacggucacauccagagcccgaauuacccagacgacuauaggcccuccaaaguguguauuuggcggauccaaguaagcgagggguuucacgugggccucacuuuccagaguuuugagaucgaaaggcaugauuccugcgccuacgacuaucuggagguccgcgauggucacagcgaauccaguacgcugauuggccgguacuguggguaugagaagcccgacgauaucaaaagcaccuccagcaggcucuggcugaaguucgugagugacggcuccauuaacaaggcaggguuugccgucaauuucuuuaaagaaguggaugagugcagccgcccaaaccggggcgguugugagcagaggugcuugaacacucugggguccuacaaguguaguugcgaccccggcuaugaacucgcgccagauaaacgccggugcgaggccgcauguggcggguuccugaccaagcugaaugguagcaucaccuccccgggcuggcccaaagaauacccacccaacaagaauugcauuuggcaguugguggccccaacucaauacaggaucagccuccaguucgacuuuuucgagacggaggggaacgauguauguaaguaugacuuuguggaaguccgcaguggccugaccgcagauuccaaacugcaugguaaguucugcgggagcgagaaacccgaagugaucacuucccaguacaauaacaugcgggucgaguuuaagagcgacaauaccgugaguaaaaagggcuucaaggcccacuuuuucagcgacaaagaugaauguuccaaggacaacggcgggugccagcaagauugugugaauaccuuugguaguuaugagugccaguguaggagcggcuucguacuccaugacaacaaacacgauugcaaggaggccgggugugaccacaaagucacuuccacgagcggcaccauuacuuccccgaauuggccagauaaguaccccaguaaaaaggaaugcaccugggcaaucagcuccacuccaggucaucgcgugaagcugaccuuuauggagauggacauugaaagucagcccgagugcgccuaugaucacuuggaaguguucgacgggcgggaugcgaaagccccgguccugggcagguucuguggcagcaagaaacccgagccagugcucgcaacggggucccgcauguuucugcgguucuacagcgacaacagugugcagaggaaggguuuucaagccucccaugccaccgagugcggcgggcagguacgcgcagacgucaaaacuaaggaucuguauagccacgcgcaguucggcgacaauaacuaccccggugggguggauugugaaugggugaucgucgccgaggaaggcuacggcguggaguugguauuucagaccuucgaaguggaggaggaaacugacugcggguaugauuacauggagcuguuugacgguuaugauuccaccgcaccaaggcucggccgguacugugggagcggucccccagaagaggucuauagugccggcgacuccgugcuggugaaguuccacagcgaugacacgauuaccaaaaagggcuuucaucucagguacaccaguacuaaauuccaagauacucugcacucccgcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4488 - RNA, 1538 nt, Artificial Sequence
  mRNA product Design3 comprising derived and/or modified sequence from Homo sapiens__NP_001191.1__HsBMP2 (opt7)
gggagagucccgcagucggcguccagcggcucugcuuguucgugugugugucguugcaggccuuauucaagcuuaccaugguggccggcaccaggugccugcucgcacuguugcugccccagguccuccuggguggggccgcgggcuuggugccagagcuggggcggcgcaaguucgccgcagccagcuccggcaggccgaguagccaacccuccgacgaaguacucagugaguuugaacugcggcugcucagcauguucggucugaaacagcgcccaacucccuccagggaugcaguggucccacccuacauguuggaccuguaucggcgccacagcgggcagccaggcuccccggcccccgaucauaggcucgagcgggcggccagucgcgcaaacaccgugaggagcuuucaccaugaagagucccuggaggaacugccagagacgagcggcaagacuacccggcgcuucuuuuucaauuugaguuccauccccaccgaagaguuuauuacuagcgccgagcuccagguguucagggaacaaaugcaggacgcccuggggaacaauuccaguuuucaccaucggaucaacauuuacgagaucauuaaaccagcaaccgccaauagcaaguuccccgucacgcgccugcucgauacuaggcuggugaaccagaaugcgucccggugggaauccuuugacguaaccccggccgugaugcgcuggacugcacagggucacgccaaccacggcuucgucguggagguggcacauuuggaagagaaacaaggggucaguaagaggcacgugcggaucuccaggagccugcaucaggaugagcacaguuggucccagauccgcccccuccugguaaccuucggccacgacgguaaggggcauccacugcacaaacgggaaaagaggcaggccaaacauaagcaacgcaaacggcucaagagcagcuguaaaaggcaccccuuguauguggauuuuuccgacgucggcuggaaugauuggauuguggccccacccggcuaccaugcguucuauugccacggggaguguccauuuccgcuggcagaccaccugaacaguaccaaucaugccaucgugcagacgcucgucaacagcgugaauagcaagauucccaaggccugcuguguaccaacugaacugagcgcaaucaguauguuguaccuggaugagaacgaaaaagugguccucaagaauuaucaggacaugguggucgaggguugcggcugucgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4489 - RNA, 1574 nt, Artificial Sequence
  mRNA product Design3 comprising derived and/or modified sequence from Homo sapiens__NP_001193.2__HsBMP4 (opt7)
gggagagucccgcagucggcguccagcggcucugcuuguucgugugugugucguugcaggccuuauucaagcuuaccaugauccccggcaacaggaugcugauggugguccuccugugccagguguugcucgggggugccagccacgcaucccugauuccagagaccggcaagaaaaagguagccgaaauccaagggcaugcgggcggucggcgcagugggcagagccacgagcuguugagggacuucgaagccacucugcuccagauguuuggccugcggcgcaggccgcagcccuccaaaagugcagugauuccagauuacaugcgggaccuguaucgccuccaaagcggcgaggaagaggaggaacagauccauuccaccgggcuggaguaccccgaaaggccagccagccgggcaaauacgguccgcuccuuccaccaugaggagcacuuggaaaacauucccgguaccagugagaauagcgccuuuagguuccuguuuaaccucuccagcaucccagaaaaugaggugaucaguuccgcggaacugcggcuguuccgcgaacagguggaucagggcccggacugggagaggggguuucaccggauuaacaucuaugaggucaugaagcccccagccgaggugguacccggccauuugauuacucgccuccuggauaccaggcuggugcaccauaaugucacucggugggaaaccuucgacgugagcccagcagugcuccgcuggacgagggagaaacaacccaacuacggucuggccaucgaagucacucacuugcaccagacccggacucaucaggggcagcacgugaggauuucccgcagucugccgcaaggcagcggcaauugggcccagcuccggccccugcugguaaccuuugggcaugaugguaggggccacgcauugacccgccggaggcgcgccaagcgguccccaaagcaucacagccagagggcgcggaaaaagaacaaaaauugucgcaggcacagucucuauguggacuucuccgaugucggguggaacgacuggaucguggcacccccaggcuaccaagccuuuuauugccauggugauugucccuucccacuggccgaccaccugaauagcacgaaccaugcaauugugcagacucucgucaauagugugaacuccagcaucccgaaggccugcuguguacccaccgagcugagcgccaucuccauguuguaccuggaugaguacgacaaagugguccucaagaacuaucaggaaaugguggucgagggcugcgggugucggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4490 - RNA, 1889 nt, Artificial Sequence
  mRNA product Design3 comprising derived and/or modified sequence from Homo sapiens__NP_001709.1__HsBMP6 (opt7)
gggagagucccgcagucggcguccagcggcucugcuuguucgugugugugucguugcaggccuuauucaagcuuaccaugcccggccuggggaggcgggcccaguggcucugcuggugguggggucuguuguguagcugcuguggcccaccgccccugcgcccaccccucccagcagccgcggccgcagccgcagggggccaacuguugggugacgggggcucccccggcaggaccgagcagccaccgcccaguccacagagcuccaguggguuccuguaccggcgccucaagacucaggagaaaagggaaaugcaaaaggaaauccugagcgugcugggucucccccaccggccacgcccccugcauggcuugcagcagccgcagcccccagcccugaggcaacaggaggaacagcagcaacagcagcaacucccccgcggggagccacccccaggccggcugaaauccgcgccgcuguuuauguuggaucucuauaacgcccugagcgcagacaaugaugaggacggugccuccgaaggggagaggcagcagaguuggccccacgaagccgcaagcuccagccagcggcgccaaccacccccaggcgccgcgcauccccugaacaggaagagucuccuggccccgggcuccgggagcgguggcgcauccccauugaccagugcccaggauagcgcauuccugaaugacgccgauauggucauguccuuugugaaccucguagaguacgacaaagaguucagcccccggcagcgccaccauaaggaauuuaaguucaaucugagucagauucccgagggggaaguggucacggccgcggaguuuaggaucuauaaagauugcgugaugggcuccuucaagaaccaaacuuuucugauuagcaucuaccagguguugcaggaacaccagcaccgggacagugaucucuuccugcuggacacccgcgucgugugggcauccgaggaggguuggcucgaauuugauauuaccgccacuagcaaucuguggguagugaccccacaacauaacaugggcuugcagcugagcgucgugacgagggacggggugcacguccauccccgggccgcaggccucguggggagggacgguccauaugauaaacagccguucaugguagccuucuuuaagguguccgagguccacgugcgcacuacccggagugcgagcuccaggcgccggcagcaaagcaggaaucgcaguacucagucccaggacguggcccgggucagcuccgcaagugauuacaacagcuccgaacugaaaaccgccuguaggaagcacgagcuguaugugagcuuccaagacuugggcuggcaggauuggaucaucgcacccaaaggguacgccgccaauuacugcgacggcgaauguaguuuuccacucaacgcacauaugaaugccaccaaccacgcgauuguacagacgcuggugcaucugaugaaucccgaguaugucccaaagcccugcugugccccgacuaagcucaacgcaaucuccgugcuguacuucgaugacaacagcaaugucauuuugaaaaaguaucggaacaugguggugcgcgccugcgguugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4491 - RNA, 1643 nt, Artificial Sequence
  mRNA product Design3 comprising derived and/or modified sequence from Homo sapiens__NP_001710.1__HsBMP7 (opt7)
gggagagucccgcagucggcguccagcggcucugcuuguucgugugugugucguugcaggccuuauucaagcuuaccaugcacgugaggagccugcgggccgcagcgccccauuccuucgucgcccucugggccccacuguuuuugcugcgcagugcacucgccgacuucagccuggauaacgaggugcacuccaguuuuauccauaggcgguugcgcagccaggaaaggcgggagaugcaacgcgaaauucuguccauccucggccugccgcacaggccccggccacaucugcaggggaagcacaauagcgcacccauguucaugcucgaccuguacaacgccauggcgguagaggaagguggcgggccaggcggucagggguuuuccuaucccuacaaagccguguucaguacccagggcccaccguuggcaagccugcaagauucccacuuucucacugacgccgauauggucaugagcuucgugaaucugguggagcaugacaaggaguuuuuccacccccgcuaucaucacagggaauuucgguucgaucugaguaaaauuccagagggcgaagccgucaccgcagccgaguuccgcaucuacaaggacuauauuagggagcgguuugauaacgaaacguuccgcaucuccguguaccagguauugcaggagcaccucgggagggaaagcgaccuguuucugcucgauucccggacucugugggcgagugaggaagguugguugguguucgacaucaccgccaccagcaaucauugggucgugaacccccgccacaaucugggccuccagcuguccguggagacucuggaugggcaaagcauuaacccaaaauuggcaggccucaucgguaggcaugggccccagaauaagcagccguuuauggucgccuucuuuaaggcaaccgaggugcacuuccggaguauuagguccacgggcagcaaacagcgcagucaaaaccgguccaagacucccaaaaaucaggaagcccugaggauggccaacguagcggagaauagcagcuccgaccagcgccaagcaugcaagaaacaugaacuguaugugaguuuucgggaccucggcuggcaggauuggaucauugccccagagggguacgccgcauacuauugugaaggugagugcgccuucccccugaacagcuacaugaaugcgaccaaccacgccaucguccagacuuuggugcacuuuauuaacccagagaccgugcccaagccauguugcgcaccgacccagcugaaugccaucuccguccucuauuucgacgauagcaguaacgugauccugaaaaaguacaggaauaugguagugcgcgcauguggcugccauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4492 - RNA, 647 nt, Artificial Sequence
  mRNA product Design3 comprising derived and/or modified sequence from Homo sapiens__NP_006264.2__HsCCL7 (opt7)
gggagagucccgcagucggcguccagcggcucugcuuguucgugugugugucguugcaggccuuauucaagcuuaccaugaaggccagcgcagcccugcucugccuguugcugaccgcggccgcauucaguccccagggccucgcccaaccaguggggaucaacacuuccaccacguguugcuacagguuuauuaauaaaaagaucccgaaacagcggcuggagagcuaucgcaggacuaccuccagucacuguccccgggaagcagucauuuucaagaccaaauuggacaaggagaucugcgccgauccaacucagaagugggugcaggacuuuaugaaacaucuggauaagaaaacccaaacgcccaagcucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4493 - RNA, 3971 nt, Artificial Sequence
  mRNA product Design3 comprising derived and/or modified sequence from Homo sapiens__NP_001954.2__HsEGF (opt7)
gggagagucccgcagucggcguccagcggcucugcuuguucgugugugugucguugcaggccuuauucaagcuuaccaugcugcucacccugaucauuuugcugcccguggucagcaaguucuccuuugugagucucagcgccccacagcacugguccugcccggagggcacucuggcagggaacgguaauaguaccuguguaggccccgccccauucuugaucuuuagccaugggaacuccauuuucaggaucgacacggaaggcacuaauuacgagcaacugguggucgacgcgggugugagcgugauuauggacuuucacuauaacgaaaaacggaucuacugggucgaucucgagcgccagcugcugcagaggguguuccucaaugggucccggcaggaacgcguaugcaacaucgagaagaaugugaguggcauggccauuaacuggaucaaugaggaagucauuuggagcaaccaacaggagggcaucauuaccgugaccgacaugaaagggaauaacucccauauccuguugagcgcacugaaguaucccgccaauguggcagucgauccaguggaaagguuuauuuucuggaguuccgagguagccgguagccucuaccgggcggaccuggauggcgugggggucaaagcccuguuggagacuuccgaaaagaucaccgcagugagucucgacgugcuggauaagcgccuguuuuggauccaguauaacagggagggcagcaauucccucauuuguagcugcgacuacgauggugggaguguccacaucuccaaacaucccacgcagcacaaccuguucgccaugagcuuguuuggcgaccggauuuucuauaguacuuggaagaugaaaaccaucuggauugccaacaagcacacuggcaaagauauggugcgcaucaaucugcauuccagcuucguaccacucggggaacugaaggugguccacccgcuggcacaacccaaagccgaggacgacaccugggaaccagagcagaaguuguguaagcucaggaaagguaacugcagcuccaccguguguggccaggaucugcagagucaucugugcaugugugcggagggguacgcccucagccgggaccgcaaguacugcgaagaugucaaugagugcgcauuuuggaaccacggcuguacgcuggguugcaaaaauacucccggcuccuauuacuguaccugcccagugggguucguguugcugcccgacggcaagaggugucaccaacucguaagcugcccgcggaacgugagugaauguucccaugauugcguccugacuagcgaggggccccuguguuuuugcccagaagguuccguguuggagcgcgacggcaaaaccugcaguggguguagcucccccgauaauggcgguugcagccagcucugugucccacugagucccguguccugggagugcgacuguuucccaggcuaugaucugcagcucgacgaaaagagcugcgccgcauccgggccgcaacccuuucuguuguucgccaacagucaggauaucaggcacaugcauuuugacggcaccgacuacgggacucugcucagccagcagaugggcaugguguaugcccuggaucacgacccaguagagaauaagauuuacuucgcgcauacggcacugaaauggaucgaacgggccaacauggaugguucccaacgcgagagguugauugaagaggggguggacguccccgagggccuggccguggauuggaucggucggagguuuuauuggaccgaccgcggcaagagccucauugggcggagugaucugaauggcaaaagguccaagaucaucacuaaagaaaacauuagccagccacgcgggaucgcaguccaccccauggccaagcggcuguucuggaccgacaccggcauuaauccgaggaucgaguccagcagucuccaggguuuggggcgccuggugauugcgagcuccgaucucaucuggccaaguggcauuacuaucgacuuucugacggauaagcuguacuggugugacgccaaacagagcgugaucgaaauggcaaacuuggauggcuccaagcggaggcggcugacccaaaaugacguagggcaccccuucgccgucgcaguguuugaggacuacgugugguucagcgauugggccaugcccuccgucaugcgcgugaacaaaaggacugguaaggaccgggugcgccuccagggcaguaugcugaaaccaagcucccucguagucgugcauccccuggccaagccaggggcagauccgugcuuguaucagaacggcgguugugagcacauuugcaagaaaaggcuggggaccgccugguguaguugccgggaaggcuucaugaaggcgagcgacggcaaaaccugccuggcccucgaugggcaucagcuguuggccgguggcgagguggaccugaagaaucaagucacuccccucgauauccuguccaaaacgcgcgugagcgaagacaacauuaccgagagucagcacaugcucguagcagaaaucaugguguccgaucaggacgauugugccccagucgggugcagcauguacgcaagguguauuuccgagggcgaggacgcgacuugccagugucugaaggguuuugccggggacggcaaauugugcagcgauaucgacgaaugugagaugggcgugcccgugugcccacccgcaaguuccaaguguaucaauaccgaaggggguuaugucugccggugcagcgagggcuaccaaggggauggcauucacugucuggacaucgaugaaugccagcugggugagcauaguuguggggagaacgccuccugcacuaauaccgaaggcggcuauacguguaugugcgccgggaggcucagcgagccgggucugauuuguccagacuccacucccccaccccacuugcgcgaagaugaccaucacuacagcgugcggaacagugauagcgagugcccgcugucccaugacggcuauugucuccacgaugggguaugcauguacaucgaagcacuggacaaguacgccugcaauuguguggucggcuauauuggugagaggugccaguaccgcgaucugaaauggugggagcuccggcacgcgggccaugggcaacagcagaaggugaucguggucgccguguguguagugguccuggugauguugcugcuccugaguuuguggggcgcacacuauuacaggacccagaaacugcucagcaagaaccccaaaaauccauaugaagaguccagccgcgacgugcgguccaggcgccccgccgacaccgaagaugggaugaguagcugcccacaacccugguucgucgugaucaaggagcaucaggaccugaagaacgguggccagccaguagccggggaggauggccaggcagccgacgguuccaugcaaccgacuagcuggcggcaggaaccccagcuguguggcauggggaccgagcagggcugcuggauuccagugaguuccgauaaagggagcuguccccaagucauggaaagguccuuucacaugccaaguuacgguacgcagacccucgagggcgggguggaaaagccccacagccuguuguccgcgaauccgcuguggcagcaacgcgcccucgaucccccacaucagauggagcugacucagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4494 - RNA, 857 nt, Artificial Sequence
  mRNA product Design3 comprising derived and/or modified sequence from Homo sapiens__NP_001423.1__HsEREG (opt7)
gggagagucccgcagucggcguccagcggcucugcuuguucgugugugugucguugcaggccuuauucaagcuuaccaugaccgccggcaggcggauggagaugcugugcgcagggcgcgugcccgcccuccuguugugccuggguuuccaccuccugcaggcggucuugagcacuaccgugaucccauccugcauuccgggcgaaaguagcgacaacuguacggcccugguacaaacugaggauaaucccaggguggcacaggucuccaucaccaagugcaguagcgacaugaacggguacugucuccauggccagugcauuuaucugguggauaugucccagaauuacugucggugcgaaguggguuauaccgggguccgcugugagcacuuuuuccugacugugcaucaaccacucagcaaagaauacguagcccugaccgugaucuugauuauccuguuucucaucacggucgugggcuccacuuauuacuucuguaggugguaucggaaccgcaagaguaaagagcccaagaaagaguacgaaagggugaccagcggcgacccagagcugccccaggucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4495 - RNA, 815 nt, Artificial Sequence
  mRNA product Design3 comprising derived and/or modified sequence from Homo sapiens__NP_000791.1__HsFGF1 (opt7)
gggagagucccgcagucggcguccagcggcucugcuuguucgugugugugucguugcaggccuuauucaagcuuaccauggccgagggcgaaaucaccacuuucaccgcacugacggagaaguuuaaccugcccccagggaauuacaaaaagccgaaacucuuguauugcagcaacgguggccacuuccugaggauucuccccgacgggacuguggauggcacccgggaccgcuccgaucagcauauccaacugcaguugagugccgaaagcgucggugagguguacauuaaguccaccgaaacugggcaguaucuggcgauggacaccgauggccuccuguacggcagucagacgccaaaugaggagugucuguuucucgaaaggcuggaggaaaaccacuauaauacuuacaucagcaaaaagcaugccgagaagaacugguucguaggguugaaaaagaaugguuccugcaaacggggcccccgcacccacuaugggcaaaaggcaauucuguuucucccacugcccgugagcuccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4496 - RNA, 1214 nt, Artificial Sequence
  mRNA product Design3 comprising derived and/or modified sequence from Homo sapiens__NP_001997.5__HsFGF2 (opt7)
gggagagucccgcagucggcguccagcggcucugcuuguucgugugugugucguugcaggccuuauucaagcuuaccauggugggcgucggggguggcgacguggaggauguaacccccaggccagggggcugccagaucagcggucgcggggcccggggcuguaacggcauuccgggggcagccgcgugggaagccgcacugcccaggcggcgcccaaggcggcaccccuccgugaauccacgcaguagggccgcagguagcccccggacucgcggcaggcggaccgaggaacgcccauccgggaguaggcucggcgaccggggucgcgggagggcccugccgggcggccgguugggugggcgcggcagggggcgggcgcccgagagggucggcggucgcggccgggggaggggcacggccgcaccacgcgccgcccccgcagcccgggggagcaggccaggucccgcgggcacuauggccgcaggguccaucaccacccugccggcccuccccgaagauggcgguagcggcgcauucccacccgggcauuuuaaggacccaaaacgccuguacugcaagaacggcggguucuuuuugcggauucaccccgauggcaggguggacggugugcgggagaaauccgauccacauaucaagcugcaacuccaggccgaggaacgcggggucgugaguauuaaaggcguaugugccaauagguaucuggcgaugaaggaggacggucggcugcucgcaagcaagugcgugacugaugaauguuucuuuuucgagcgccuggaguccaacaauuacaacaccuauaggagccggaaauacacgaguugguaugucgccuugaagcgcacuggccaguacaaacugggguccaagaccggcccggggcagaaagccauccucuuucugcccaugagcgcaaaguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4497 - RNA, 932 nt, Artificial Sequence
  mRNA product Design3 comprising derived and/or modified sequence from Homo sapiens__NP_002000.1__HsFGF7 (opt7)
gggagagucccgcagucggcguccagcggcucugcuuguucgugugugugucguugcaggccuuauucaagcuuaccaugcacaaguggauccugaccuggauucuccccacucuguuguacaggagcugcuuccauaucauuugucuggugggcaccaucucccucgccugcaacgacaugacgccagagcagauggcaacuaaugucaacuguaguagcccggaacggcacacccgcuccuaugauuacauggaagggggugacauuagggugcggcgccuguuuugcaggacccaaugguauuugcggaucgauaaacgcggcaagguaaaagggacucaggagaugaagaauaacuacaauaucauggagauuaggaccguggccgucggcaucguggcgauuaaagguguggaaagugaguucuaucuggccaugaacaaggaggggaagcucuacgccaaaaaggaauguaaugaggacugcaacuuuaaagaacugauccuggagaaucauuauaacacguacgcaagcgcaaaguggacucacaauggcggcgagauguucgucgcccucaaccagaaagggauucccgugcgggguaagaaaaccaagaaggaacagaaaacugcgcauuuucugccaauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4498 - RNA, 974 nt, Artificial Sequence
  mRNA product Design3 comprising derived and/or modified sequence from Homo sapiens__NP_001936.1__HsHBEGF (opt7)
gggagagucccgcagucggcguccagcggcucugcuuguucgugugugugucguugcaggccuuauucaagcuuaccaugaagcugcuccccagcgugguccugaaauuguuccuggccgcagugcucuccgcccugguaaccggcgagaguuuggaaaggcugcggcgcgggcucgcggccgguacuagcaacccagacccgcccaccguguccacggaucagcugcugccacucggcgggggcagggaccggaagguccgcgaucugcaagaggcagacuuggaucugcucagggugacucugaguagcaaaccccaggcccuggcaaccccaaauaaggaggaacacgguaaacggaagaagaaagggaagggcuugggcaaaaagcgcgaccccugccucaggaaauacaaggauuuuuguauccauggggaaugcaaauaugugaaggagcugcgggccccauccuguauuugccacccggguuaccauggcgagcgcugucacgggcugagccuccccgucgaaaacaggcuguauaccuacgaccauacuaccaucuuggcggugguagccgugguccuguccagugugugccuccuggugauugucggccuguugauguuccgguaucaccgcagggguggguacgauguggagaaugaagagaagguaaaacucggcaugacgaacagccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4499 - RNA, 2534 nt, Artificial Sequence
  mRNA product Design3 comprising derived and/or modified sequence from Homo sapiens__NP_000592.3__HsHGF (opt7)
gggagagucccgcagucggcguccagcggcucugcuuguucgugugugugucguugcaggccuuauucaagcuuaccaugugggugaccaagcugcuccccgcccuguugcugcagcacguccuccugcauuugcugcuccugccaaucgcaauuccguacgccgagggccaaaggaaacggcgcaacacuauccacgaauuuaagaaaagcgcgaagaccacgcugauuaaaaucgaccccgcccucaagauuaagacuaaaaaggugaauaccgcagaucagugcgccaacagguguacccggaauaaagggcugccauucacuugcaaggcauucguauuugacaaagcccgcaagcaguguuugugguuccccuuuaacuccaugaguagcggugugaaaaaggaguucggccaugaauuugaucuguaugagaauaaggacuacaucaggaacugcaucauugggaaaggccgguccuauaaggguaccgucaguaucacgaaaagcgggauuaagugucagccaugguccagcaugaucccccacgaacauuccuuccucccaaguagcuaccgcggcaaagaucugcaagagaauuauugcaggaacccgcggggcgaggaagggggucccugguguuuuacuuccaauccagaggugcgcuacgaagugugcgacauuccccaguguagcgaggucgagugcaugaccugcaacggcgaaaguuauagggggcugauggaucacacugaguccggcaagaucugucagcggugggaccaccagaccccacaucgccacaaguucuugcccgaaagguacccggauaaagguuuugacgauaauuacugccggaaccccgacgggcaaccacgccccugguguuauacccucgauccacauacgaggugggaguacugcgcgauuaagacuugugccgacaauaccaugaacgacacugaugugccccuggaaaccaccgagugcauccagggccagggcgagggguaucgggguacuguaaauacgaucuggaacggcauuccaugucagcgcugggacagccaauacccgcacgaacacgauaugacccccgagaacuucaaaugcaaggaccugagggaaaauuauugucggaacccagauggguccgagagucccuggugcuucacuaccgacccaaauaucagggugggcuacugcagccagauucccaacugugauaugucccauggucaggacugcuaucgcggcaaugggaaaaacuacaugggcaaucucagccaaacccggagugggcugacuuguuccaugugggauaagaacauggaagacuugcacaggcauaucuuuugggagccggaugcaagcaagcugaaugagaacuacugccgcaauccagacgacgaugcccacggucccugguguuauacgggcaacccccucauuccaugggacuacugccccaucagucggugugaaggggauaccacuccaaccaucgucaaucuggaccauccggugauuuccugcgccaaaaccaagcagcugaggguggucaacggcauccccacucgcacgaauauugguuggauggugagcuugcgguauaggaacaaacacaucuguggcgggagccucauuaaggaguccuggguacugaccgcacggcagugcuucccaagucgcgaucugaaagacuacgaagccuggcucggcauccacgaugugcaugggaggggcgacgagaaguguaagcagguccugaacgugagccaauugguguauggucccgaaggguccgaucugguccucaugaaacuggcgcggccagccgugcuggacgauuuuguaagcacuaucgacuugcccaauuacggcugcaccauuccggagaagaccaguugcuccguguaugguuggggcuacacugggcucaucaacuacgauggccugcugcgcgucgcacaccucuauauuauggggaaugagaaauguagccagcaucacaggggcaaggugacgcugaacgaauccgagaucugcgccggugcagagaaaauugggaguggcccaugugaaggcgacuacgggggucccuuggucugcgagcagcacaagaugcggauggugcugggcgugaucguaccagggcgcggcugugccauucccaauaggccggguaucuucgugcgggucgccuauuacgcgaaauggauccauaagauuauccucaccuauaaggugccccagagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4500 - RNA, 2273 nt, Artificial Sequence
  mRNA product Design3 comprising derived and/or modified sequence from Homo sapiens__NP_005336.3 __HsHSPA1A (opt7)
gggagagucccgcagucggcguccagcggcucugcuuguucgugugugugucguugcaggccuuauucaagcuuaccauggccaaggcagccgcgaucggcauugaccuggggaccacuuacagcugcgugggugucuuccagcacggcaaaguggagaucauugccaacgaucaagggaauaggaccacgcccuccuauguagcauuuacugacaccgaacggcucaucggcgaugccgcaaagaaccagguggcccugaauccacagaacaccgucuucgacgcgaaacgcuugauugguaggaaguuuggggauccgguggugcagagugacaugaaacauuggcccuuccaagucaucaaugauggcgacaagccaaaggugcagguaagcuacaaaggcgagacuaaggccuuuuaucccgaagagaucuccaguauggugcugaccaaaaugaaggaaauugcagaggccuaccucggguauccagucacgaacgccgugaucacugugcccgcauacuucaaugauagccagcggcaggccaccaaagacgcgggugucauugccggccugaacguguugcgcaucauuaaugagccaacugcagccgcaaucgccuaugggcuggauaggaccggcaagggugaacggaacguacucauuuuugaccucgggggcggcaccuucgauguguccauccugacgaucgacgacgggauuuuugaggucaaagccacugcgggugauacccaccugggcggggaagacuucgauaaucgccuggugaaccauuuuguggaggaguucaagaggaagcacaaaaaggacaucagccaaaauaaacgggcaguccgcagguugcggacugccugugaacgcgccaagaggacccuguccaguagcacccaggcaucccucgagauugauagccuguucgaaggcaucgacuuuuacacuagcauuacgcgggcccgcuucgaggaacugugcuccgauuuguuuaggagcacccucgagccgguggagaaagcgcugcgggacgccaagcuggauaaggcacagauccaugaccucguacugguggguggcuccacucgcauccccaaaguccagaaguugcugcaagauuucuuuaacgggagggaccucaauaaaaguauuaacccagacgaagccguggcauacggcgccgccguccaggcagccauccugaugggggauaagagcgagaacgugcaggaccuguugcuccuggauguggcgccccugucccucggucuggaaaccgccggcgggguaaugaccgcauugauuaaacggaauagcacuaucccaacgaagcaaacccagauuuucacuaccuauagugacaaccagcccggcgugcugauccaggucuacgagggugaaagggccaugaccaaggauaauaaccuccugggccgcuuugagcuguccgggaucccgcccgccccacggggcgugccccaaauugaggucacuuucgacaucgaugcaaaugggauuuugaacgugacggcgaccgacaaaagcacuggcaaggccaauaaaaucaccauuacuaacgauaaggguaggcucaguaaagaagagaucgaacgcauggugcaggaggcagaaaaguauaaggccgaggacgagguacagcgggaaaggguguccgccaaaaaugcacuggagagcuacgccuuuaacaugaagagugcggucgaagaugaggggcugaaaggcaagauuuccgaggccgacaaaaagaaagugcucgauaagugucaggaagucaucaguuggcuggacgcaaauaccuuggccgagaaggacgaguucgaacacaaacgcaaggaacuggagcaagugugcaacccaaucauuagcggucucuaucagggcgccgggggccccgggccaggcgguuuuggggcacagggcccgaaaggcggguccgguagcggccccacgaucgaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4501 - RNA, 2273 nt, Artificial Sequence; identical to SEQ ID NO: 4500
  mRNA product Design3 comprising derived and/or modified sequence from Homo sapiens__NP_005337.2 __HsHSPA1B (opt7)

SEQ ID NO: 4502 - RNA, 2273 nt, Artificial Sequence
  mRNA product Design3 comprising derived and/or modified sequence from Homo sapiens__NP_005518.3 __HsHSPA1L (opt7)
gggagagucccgcagucggcguccagcggcucugcuuguucgugugugugucguugcaggccuuauucaagcuuaccauggccaccgcaaagggcaucgccauugggaucgaccuggguacuaccuacagcugcgugggcgucuuccagcacgggaaaguggagauuaucgcgaacgaucaaggcaauaggacgacucccuccuauguagccuuuaccgacaccgaacggcucauuggugaugcagccaagaaccagguggcaaugaauccacagaacacugucuucgacgccaaacgccugaucgggaggaaguuuaaugauccgguggugcaggcggacaugaaauuguggcccuuccaagucaucaacgagggcggcaagccaaaggugcugguaaguuacaaaggggaaaauaaggccuuuuaucccgaggaaauuagcuccauggugcucaccaaacugaaggagacggcagaggccuucuugggucauccagucacuaacgccgugaucaccgugcccgcauacuuuaaugauagucagcggcaggccacuaaagacgcgggcgucauugccgggcugaacgugcuccgcaucauuaaugaaccaaccgcagccgcaaucgccuauggccuggauaagggugggcagggcgagaggcacguacugauuuucgaccucggcggggguaccuuugaugugagcauccugacgaucgacgauggcauuuucgaagucaaagccacugcgggggacacccauuugggcggugaggacuuugauaaccggcuggugucccacuucguggaggaguucaagcgcaagcauaaaaaggacaucagccaaaauaaaagggcaguccggcgccucaggacugccugugagcgggccaagcgcacccuguccaguagcacccaggcaaaccuggaaauugauuccuuguacgagggcaucgacuuuuauacuagcauuacgagggcccgguucgaagaacucugcgcggaucuguuucgcgggacccuggagccgguggaaaaagcccucagggacgcaaagauggauaaggccaaaauccacgacaucguacuggugggcgggaguacucggauucccaagguccagcgcuugcugcaggauuacuucaaugguagggaccucaacaaauccaucaacccagaugaggcaguggccuacggcgccgcaguccaagccgcgauucugaugggggacaagagcgaaaaagugcaggaccuguugcuccuggauguggcaccccugucccucggccuggagaccgccgguggcguaaugaccgccuugaucaagcggaauaguacuauuccaacgaagcagacccaaaucuuuacuaccuauagcgacaaccagcccggggugcugauccaggucuacgaaggcgagagggccaugaccaaagauaauaaccuccuggggcgcuucgaccugacuggcauuccgcccgcaccacggggugugccccagaucgaggucacguuugauauugacgcgaaugggaucuugaacgugaccgccacugauaaguccaccggcaaagugaauaagauuacuaucaccaacgacaaagguaggcucagcaaggaagagauugaacgcaugguacuggaugcagagaaguauaaagccgaagacgaggugcaacgggagaagaucgccgccaaaaaugcacuggaaaguuacgcguucaacaugaaguccgucgugagcgaugagggccucaaagggaagaucagugaauccgacaaaaauaagauucuggauaaguguaacgaguugcugagcuggcucgaggucaaucagcuggccgaaaaagacgaguuugaccacaagaggaaagaacuggagcagaugugcaacccaaucauuacgaaguuguaucagggcggguguaccggccccgcaugcgguacuggguacgugccaggccgcccggccaccggccccacuaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4503 - RNA, 2267 nt, Artificial Sequence
  mRNA product Design3 comprising derived and/or modified sequence from Homo sapiens__NP_068814.2 __HsHSPA2 (opt7)
gggagagucccgcagucggcguccagcggcucugcuuguucgugugugugucguugcaggccuuauucaagcuuaccaugagcgccaggggccccgcaaucgggauugaccuggguaccacuuacuccugcgugggcgucuuccagcacgggaagguggagaucauugccaacgaucagggcaaucggaccacgccaaguuauguagcguuuacugacaccgaacgccucaucggugaugccgccaaaaaccagguggcaaugaauccgaccaacacuauuuucgacgcaaagaggcugaucgggcggaaauuugaggaugccaccguccagagcgacaugaagcauuggcccuuccgcgugguguccgaaggcggcaaaccaaagguccagguggaguacaagggggaaacgaaaaccuuuuuccccgaggagaucaguagcaugguauugacuaagaugaaagaaauugcggaggccuaucuggguggcaaggugcacuccgcagucaucacugugccagccuacuuuaaugauagccaaaggcaggccaccaaagacgcagggaccauuacgggccucaacgugcugcggaucauuaaugaacccacugccgcggccaucgcauaugguuuggauaagaaagggugugccggcggcgagaagaacguccugauuuucgaccucggggguggcaccuuugauguguccauccugacuaucgaggacgggauuuucgaaguaaagaguaccgcaggcgauacccaucuggguggcgaggacuuugacaaucgcauggugagccaccucgccgaagaguucaaaaggaagcauaaaaaggauaucgggccaaacaaacgggccguccgcaggcugcggacugcgugcgaacgcgcaaagaggacguuguccagcaguacccaggccuccauugagaucgacagccuguacgagggcguggauuucuauacuuccauuacccgggcccgcuuugaggaacucaaugcagaccuguucagggggacccuggaaccgguggagaaggccuugcgggaugcgaaacucgacaagggucagauccaagaaaucguccuggugggcgggaguacucgcauucccaaaauccagaagcugcuccaggacuuuuucaacggcaaagagcugaauaagagcauuaacccagaugaggccguagcauacggugccgcagugcaggccgccaucuugauuggcgauaaguccgaaaauguccaagaccugcuccugcuggaugugacgcccuugagccucgggaucgagaccgcaggcggggucaugacuccacugaucaaaaggaacaccaccauucccacuaagcagacgcagaccuuuacuaccuacagugacaaccaauccagcgugcuggugcagguauaugaaggcgagcgggccaugacuaaagacaauaaccuccuggguaaguucgauuugaccgggaucccgcccgcgccaaggggcgugccccagauugaagucacguuugacaucgaugccaaugguauucugaacgugaccgcagccgacaaaaguacuggcaaggagaauaagaucaccauuacuaacgauaaagggcgccucuccaaggacgauaucgaccggaugguccaggaggccgaaagguacaaaagcgaggaugaagcaaaucgcgaccggguggcggccaagaacgcacuggagagcuauaccuacaauaucaaacaaacgguggaggaugaaaagcugaggggcaaaauuuccgagcaggacaagaacaagaucuuggauaaaugucaggaaguaauuaauuggcucgaccgcaaccagauggccgagaaggacgaauaugagcacaaacaaaaggagcuggaacgggugugcaauccaaucauuaguaaacuguaccaagggggccccggugggggcagcggcggggguggcuccggggccagcggcgguccaaccaucgaggaagucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4504 - RNA, 2870 nt, Artificial Sequence
  mRNA product Design3 comprising derived and/or modified sequence from Homo sapiens__NP_002145.3 __HsHSPA4 (opt7)
gggagagucccgcagucggcguccagcggcucugcuuguucgugugugugucguugcaggccuuauucaagcuuaccaugagcguggucggcaucgaccugggguuccaguccugcuacguggccguagcaagggccgguggcauugagaccaucgcgaacgaauauagugaucgguguacucccgccugcauuagcuuugggccaaagaaucgcuccaucggcgcagccgcaaaaagucaagugauuagcaacgccaagaauaccguccaggguuucaaaagguuucacgggcgggcguucuccgacccguuuguggaggccgaaaagagcaaccucgcauacgauaucgugcagcugcccacgggcuugacuggcaucaaagucaccuauauggaggaagaacgcaauuucaccacugaacaggugaccgccaugcugcucuccaagcugaaggaaacggccgagaguguauugaaaaagccaguggucgacuguguggugagcguccccugcuuuuacacugaugcagaaaggcgguccgugauggacgccacccaaauugcggggcugaacugucuccgccugaugaaugagacuaccgccguagcacuggccuaugguaucuacaaacaggaucucccagcacuggaggaaaagcccaggaacguggucuucguggacaugggccauagcgccuaucaggugagugucugcgccuuuaaucgggggaaauugaaggugcuggcgaccgcauucgauacgacucucggcggucgcaaauuugacgagguacuggugaaccacuucugugaagaguucgggaagaaguacaaacuggauauuaaguccaaaaucagggccuugcuccggcugagccaggaaugcgagaagcugaaaaagcucauguccgccaaugcaagugaccugccauugagcauugaguguuuuaugaacgaugucgacguguccggcaccaugaaucgcggcaaguuccuggaaaugugcaacgaccuccuggccagggucgagccgccccugcggagcguguuggaacaaacuaaacucaagaaagaggauaucuacgcgguggaaauuguagggggugccacccgcaucccagcagugaaggagaaaaucaguaaguuuuucggcaaggagcuguccaccacucugaaugccgacgaagcagucacgagggggugcgcccuccagugugccauucugagccccgcauuuaaagugcgggaguucaguaucaccgaugucgugccauaucccauuuccuugcgcuggaacagcccggccgaagagggcagcuccgacugcgaaguguuuaguaagaaccaugcggcccccuucagcaaaguacugacuuuuuacaggaaggagccauucacccucgaggcauauuacuccagcccccaggaucugccauaucccgacccagccaucgcccaguuuagugugcaaaaagucaccccgcaguccgaugguagcuccaguaaggugaaggucaaagugcgggugaauguacacggcauuuucagcgucuccagcgcaagucugguggaagugcauaaguccgaggaaaacgaggagcccauggaaacugaccagaaugcgaaagaggaagagaagaugcaagucgaucaggaggagccacacguggaggaacagcagcaacagacgcccgccgagaacaaagcagaaagcgaggaaauggagaccucccaggccgggaguaaggacaaaaagauggaucagccaccccaagccaagaaagcaaaggugaaaacuagcaccguagacuugccgaucgagaaucagcuccuguggcagaucgacagggaaaugcugaaccucuacauugagaaugaaggcaagaugaucaugcaggauaaacuggagaaggaacgcaacgacgccaagaaugcggucgaggaguauguguacgaaaugcgggauaaauuguccggggaguacgaaaaguuugugagcgaggacgauaggaacaguuucacccugaaacucgaggacacugaaaauuggcuguaugaggauggugaagaccaaccaaagcaggucuacguggauaaacuggccgaguugaagaaccugggccagcccauuaagauccgcuuccaggaauccgaggagcggcccaaacucuuugaggagcuggggaagcaaauucagcaguauaugaaaaucaucagcuccuucaagaauaaagaagaccaauacgaucaccucgacgcagccgauaugacgaagguagagaaaagcaccaacgaagccauggaguggaugaauaacaagcugaacuugcagaauaagcagagucugacuauggacccaguggucaaaagcaaggagauugaagcaaaaaucaaggagcucaccuccacuuguagucccauuaucagcaaaccaaagccgaagguggaacccccaaaagaggagcagaagaacgccgaacaaaauggccccguggacggucagggcgauaacccagggccccaggcggccgagcagggcaccgacacggcagucccguccgauagcgacaaaaagcugccagaaauggauauugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4505 - RNA, 2867 nt, Artificial Sequence
  mRNA product Design3 comprising derived and/or modified sequence from Homo sapiens__NP_055093.2 __HsHSPA4L (opt7)
gggagagucccgcagucggcguccagcggcucugcuuguucgugugugugucguugcaggccuuauucaagcuuaccaugagcguggucggcaucgaccugggguuccucaacugcuacauugccguggcaagguccgguggcaucgagaccauugccaaugaauauagugaucgguguacucccgcgugcaucagccuggggucccgcaccagggccauuggcaacgcagccaagagucagaucguaacgaaugugcggaacacuauccacgguuuuaaaaaguugcaugggcgcagcuucgacgauccaauuguccaaaccgagaggauccggcugccguacgaacuccagaaaaugcccaauggcuccgcaggcgugaaggugcgcuaucuggaggaagagaggccauuugccauugagcaggucaccgggauguugcuggcgaaacucaaggaaacuagcgagaacgcccugaagaaacccguggcagacuguguaaucuccauuccaaguuucuuuaccgaugccgaacggcgcagcgugauggccgcagcccaggucgcgggucugaauugccucaggcugaugaacgagacgacugccguggcauuggccuacggcaucuauaagcaagaccugcccccacucgaugagaaaccgcggaauguggucuucauugacauggggcacuccgcauaccaggugcugguaugugccuuuaacaagggcaaacugaagguguuggccaccacuuucgaucccuaucucggugggcgcaauuuugacgaagcgcuggucgauuacuucugcgacgaguuuaaaaccaaguacaagaucaacgugaaagaaaauagcagggcacugcuccggcuguaucaggagugugaaaaguugaaaaagcugaugagugccaacgccuccgaucucccacugaauaucgagugcuucaugaacgaccuggacgugagcuccaaaaugaaccgcgcacaguucgagcaauugugugccagucuccuggcgagggucgaacccccacugaaggccgugauggagcaggcaaaucuccagcgggaagauauuagcuccaucgagauuguaggcggcgccacccgcauccccgcagugaaggaacagauuacgaaauuuuuccugaaggacaucagcacuaccuugaacgccgaugaggccgucgcaagggggugcgcccugcaaugcgcgauccucaguccggccuuuaaagugcgggaguucuccauuacugaccugguccccuacagcaucacccugagguggaagaccaguuuugaagaugguuccggcgagugugaaguguucugcaaaaaucauccagcacccuuuagcaaggugauuacuuuccacaagaaagagccauuugaauuggaggccuucuauacgaaccuccaugagguacccuacccagacgcccgcaucgggagcuuuaccauucagaauguguucccgcaguccgauggcgacaguagcaaggucaaagugaagguccgggugaacauccacgguaucuuuuccguggcaagcgcgaguguaauugaaaaacaaaaucuggagggcgaucacuccgacgcccccauggaaacugagaccagcuucaagaacgagaauaaggauaacauggacaaaaugcaaguggaccaggaagaggggcaucagaagugucacgcagaacauaccccagaggaagagaucgaucacacuggcgccaaaacgaaguccgccgucagugacaaacaggauaggcugaaucagacccucaagaaagggaaggugaaguccauugaccugcccauccaguccagcuugugccgccagcugggucaagaucuccugaacaguuauauugagaaugaaggcaaaaugaucaugcaggacaagcuggagaaagaacggaacgaugcaaagaaugccgucgaggaauacguguaugacuucagggaucgcuuggggacuguguacgagaaauuuauuaccccagaggaccuguccaagcucagcgcgguacuggaagauaccgagaacuggcucuacgaagacggcgaggaucagcccaagcaggucuauguggacaaacugcaagaauugaagaaauacggucagccgauccagaugaaguauauggagcacgaggaacggccaaaagcccugaacgaccucggcaagaagauccagcuggugaugaaagucauugaggcauacaggaauaaggaugaacgguaugaccaucuggaucccacugagauggagaaaguggaaaaguguaucuccgacgccaugaguugguugaacagcaaaaugaaugcccaaaacaagcugucccucacgcaggaucccgugguaaaagucagcgagauuguggcaaagaguaaggaacuggacaauuucugcaacccaaucauuuacaaacccaagccaaaagccgaggugccggaagauaagcccaaagcgaauagcgagcacaacgggccaauggacggccagagcgggaccgagacuaaguccgauagcaccaaggacaguagccaacauacuaaauccaguggcgaaauggaggucgauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4506 - RNA, 2312 nt, Artificial Sequence
  mRNA product Design3 comprising derived and/or modified sequence from Homo sapiens__NP_005338.1__HsHSPA5 (opt7)
gggagagucccgcagucggcguccagcggcucugcuuguucgugugugugucguugcaggccuuauucaagcuuaccaugaagcugagccucguggccgcaaugcuguugcugcucuccgccgcgagggccgaggaagaggacaaaaaggaagaugucggcaccgugguagggaucgaccuggguacuaccuacaguugcgugggcgucuucaaaaacgggcggguggagauuaucgcaaaugaucagggcaaccgcauuacgcccagcuauguggccuuuacuccagaaggugagagguugaucggggacgcagccaagaaucaacugaccuccaacccggagaauaccgucuucgaugcgaaacggcucauuggccgcacuuggaacgaccccagugugcagcaggauaucaaguuucugccauucaagguaguggagaaaaagaccaaacccuacauccaggucgacauuggcgggggucaaacgaagacuuuugccccagaagaaaucagcgcaauggugcugaccaaaaugaaggagacugccgaggccuaucucggcaaaaaggugacccacgcagucgugaccguacccgccuacuucaaugaugcgcagaggcaggccacgaaggacgcagggacuauugccggccugaacgugaugcggaucauuaaugaaccaaccgcagccgccaucgcguaugguuuggauaaacgcgagggggaaaagaacauucuggucuuugaccucggcggcgggacuuucgaugugucccugcugaccaucgacaaugguguguuugaggucguggcaaccaacggcgacacucaucucgggggcgaagauuucgaccagaggguaauggagcacuuuaucaaauuguacaagaaaaagacggguaaggaugugcggaaagacaaucgcgccguccaaaagcugaggcgggagguggaaaaagccaagcgcgcacugagcucccagcaucaggccaggauugagaucgaaaguuucuaugagggcgaagauuucagcgagacccucacucgggcgaaauuugaggaacugaacauggacuuguuccgcuccaccaugaagccgguccagaaggugcuggaggauagcgaccucaaaaagagugauauugacgaaaucgugcugguagggggcuccaccaggauucccaaaauccaacagcuggugaaggaguuuuucaaugggaaagaaccaagccgggguaucaaccccgaugaggccgucgcauacggcgccgcagugcaggccggggucuuguccggcgaccaagacacuggugaucucgugcugcuggacguguguccacucacgcugggcauugagaccguagggggcgugaugacuaaguugaucccccgcaacaccgucgugccgaccaagaaaagucagauuuuuagcacugccuccgauaaucagcccacggucaccaucaagguguacgaaggggagaggccacugacuaaagacaaccaccuccugggcaccuucgaucugacugguauucccccagcaccccggggcgugccacagaucgaaguaaccuuugagaucgacgucaaugggauuuugagggugacggccgaggauaaggguaccggcaacaaaaauaagaucacuauuaccaacgaccaaaaucgccucacuccggaagagaucgaacggauggugaacgaugcggagaaauucgccgaagaggacaagaagcugaaagagaggauugauacccgcaaugaacuggagagcuaugcauacagucucaagaaccagaucggggacaaagaaaagcugggcgggaaauuguccagcgaggauaaggaaacgauggagaaggccgucgaggagaaaauugaauggcuggaaagucaucaggacgccgacaucgaggauuuuaaggcgaaaaagaaagaacucgaggagaucgugcagcccauuaucuccaagcuguauggcagcgcagguccacccccaaccggggaagaggacacugccgaaaaggaugagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4507 - RNA, 2279 nt, Artificial Sequence
  mRNA product Design3 comprising derived and/or modified sequence from Homo sapiens__NP_002146.2__HsHSPA6 (opt7)
gggagagucccgcagucggcguccagcggcucugcuuguucgugugugugucguugcaggccuuauucaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuucagggucguguccgaagggggcaagccaaaaguacggguguguuaccgcggcgaggauaagacguuuuaucccgaagagauuaguagcaugguccuguccaagaugaaagagacugccgaagcauacuuggggcagccagugaagcacgccgugaucaccguccccgccuauuucaacgacagccagaggcaggcaacuaaagaugccggugcgauugccggccugaaugugcuccggaucaucaacgagccaaccgcagccgcaauugccuacgggcuggaccgcaggggcgccggugaacggaauguacugaucuuugaucucgggggcggcaccuucgacguguccguccugaguauugaugcggggguguuugaggugaaggcaacggccggugacacucauuugggcggggaggacuucgauaaccgccuggucaaucacuuuauggaagaguucaggcggaaacauggcaaggaccucagcgguaacaaacgcgcccugaggcggcugcgcaccgcaugcgaaagggccaagcggacuuuguccagcaguacccaagcgacccucgagaucgauucccuguucgaaggcguggacuuuuauacuagcauuacgagggcccgcuucgaggagcuguguuccgaucucuuucggaguacccuggaaccgguagagaaggcauugagggacgccaaacuggauaaggcacagauccacgacgugguccucgucgggggcagcacucgcauucccaaagugcagaagcugcugcaggauuucuuuaaugggaaagaauugaacaaguccaucaauccagacgaggccguggccuacggugcagccgugcaagcggccguacucaugggcgauaagugcgaaaaagugcaggaccugcugcuccuggacgucgcacccuugagccuggggcucgagaccgccggcggugugaugaccacucugauccagcggaacgccacgauuccaaccaagcaaacucagaccuucaccacuuacagugauaaucagcccggcgucuuuauccagguguaugagggggaaagggcaaugacgaaagacaacaaccuguugggccgcuucgagcucuccgggauuccgcccgcgccacggggcgugccccaaaucgaaguaaccuuugauauugacgccaaugguauccugagcgugacugcaaccgauaggaguacugggaaggccaacaaaaucaccauuacgaaugacaagggccggcuguccaaggaggaagucgagcgcauggugcacgaggccgaacaguacaaagcagaggaugaagcccagagggaccgggucgcggccaagaacagccucgaggcacauguguuccacgugaaagguagccugcaggaggaauccuugcgcgauaagaucccagaggaagacaggcggaaaaugcaagauaagugucgcgagguacuggccuggcucgaacauaaucagcuggccgagaaggaggaauaugagcaccagaaaagggaacuggagcagauuugccggcccaucuuuaguagguuguacggcgggccaggcguccccgggggcagcuccugugguacccaagcacgccagggggacccgagcacuggcccaauuaucgaagagguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4508 - RNA, 1451 nt, Artificial Sequence
  mRNA product Design3 comprising derived and/or modified sequence from Homo sapiens__P48741__HsHSPA7 (opt7)
gggagagucccgcagucggcguccagcggcucugcuuguucgugugugugucguugcaggccuuauucaagcuuaccaugcaggcccccagggagcuggcagugggcaucgaccucgggaccacuuacagcugcgucgguguguuccaacagggccggguagaaauucuggccaacgaucaggggaaucgcaccacgccauccuauguggcguuuacugacaccgagagguuggucggcgaugccgcaaagagucaggccgcacugaacccgcacaauaccguguucgacgccaaacggcucaucggucgcaaguuugcggauacuaccgugcaaagcgacaugaaacauuggcccuuccaggucguguccgaagggggcaagccaaaaguaaggguguguuaccggggcgaggauaagacguuuuaucccgaagagauuaguagcaugguccuguccaagaugaaagagacugccgaagcauacuuggggcagccagugaagcacgccgugaucaccguccccacuuauuucagcaacucccagcgccaagccaccaaagacgcaggggccauugcgggccugaaggugcucccaaucaucaaugaggccaccgcagccgcaauugccuacgggcuggauaggcggggcgccgguaaacgcaacguacugaucuuugaccucgggggcggcacguucgaugugaguguccugagcauugacgcggggguguuugaagugaaggcaacugccggugauacccauuugggcggggaggacuucgacaauaggcuggucaaccacuuuauggaggaguuccggcgcaaacauggcaaggaucucuccgguaauaagagggcccugcggcgccugaggacugcaugcgagcgggccaaacgcaccccgagcaguuccacccaggcgacuuuggaaaucgacagccucuucgagggcguggauuuuuauaaguccauuacgagggcccgguucgaagaacuguguagugaccuguuuaggagcacccucgagcccguagaaaaagcacugcgcgaugccaaguuggacaaagcacagauccacgauuucgugcuggguggcgggcuccacucccauccacagggugccgaggucgccgcaggccugcugcaacggcagggggccgaacaggagcaccaacccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4509 - RNA, 2288 nt, Artificial Sequence
  mRNA product Design3 comprising derived and/or modified sequence from Homo sapiens__NP_006588.1 __HsHSPA8 (opt7)
gggagagucccgcagucggcguccagcggcucugcuuguucgugugugugucguugcaggccuuauucaagcuuaccaugagcaagggccccgccguggggaucgaccuggguaccacuuacuccugcgucggcguguuccagcacgggaaaguagagauuaucgcaaacgaucaaggcaauaggaccacgccaaguuauguggccuuuacugacaccgaacggcucauuggugaugcggccaagaaccaggucgcaaugaauccgaccaacacuguguucgacgccaaacgccugaucgggaggcgguuugaugacgcagugguccagagcgauaugaagcauuggcccuucauggugguaaaugacgccggccgcccaaaagugcaggucgaguacaagggcgaaaccaaguccuuuuaucccgaggaagugaguagcaugguguugacgaaaaugaaggagauugcggaggccuaccuggggaaaacugucaccaacgcagugguaacugugccagccuauuucaaugauucccaaaggcaggccaccaaggacgcagguaccaucgccggccucaacguccugcggaucauuaaugaacccacggcggccgcaaucgccuacggguuggauaaaaaggugggcgcagagcgcaacgugcugauuuuugaccucggugggggcacuuucgaugucagcauccugaccauugaagacggcaucuuugaggugaaauccacugccggggacacccaccuggguggcgaggauuucgacaauaggaugguaaaccauuuuauugccgaauuuaagcggaagcacaaaaaggauaucagugagaauaaacgcgcggugaggcggcuccgcaccgcaugugaaagggccaagcggacucugagcuccagcacgcaggccaguaucgagauugacuccuuguaugaagggaucgauuucuacaccagcauuacucgcgcaagguuugaggagcugaacgccgaccucuuccggggcacccuggauccagucgaaaaagcgcugcgcgacgccaaguuggauaagucccagauccaugacauugugcucgucgguggcaguaccaggaucccgaaaauccaaaagcugcugcaggauuucuucaaugggaaagagcucaacaagagcauuaaccccgacgaagcaguggccuacggcgcagccgugcaggccgcaauccuguccggggacaaaagcgagaauguacaggauuugcugcuccuggacgugacuccacugaguuuggguauugaaacggccggcggggucaugaccgugcucaucaagcggaacacuaccauucccaccaagcaaacucagacguuuaccacuuauuccgauaaucagccaggcguccugauccaaguguacgagggugagagggcgaugaccaaagacaacaaucugcucggcaaguucgaacugacugggauucccccggcaccccgcggcgugccacagaucgagguaaccuuugauaucgacgccaacgggauuuugaaugugagcgccgucgauaaaaguacgggcaaggaaaacaaaaucaccauuacuaaugacaagggucggcuguccaaggaggauaucgaaaggauggugcaggaggccgagaaauauaaggcagaagacgagaaacagcgcgauaaggucagcagcaaaaacucccucgaaaguuacgcguucaauaugaaggccaccguggaggacgagaaacugcaagggaagauuaacgaugaagacaagcagaaaauccuggacaagugcaaugagaucauuaacugguuggauaaaaaucagacugcagaaaaggaggaauuugagcaccagcaaaaagagcucgaaaagguguguaaccccaucauuaccaagcuguaucagagcgccggcgguaugccaggcgggaugcccggcggguucccaggcgguggggccccgcccuccggcggcgcaagcagugggccaacgaucgaggaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4510 - RNA, 2387 nt, Artificial Sequence
  mRNA product Design3 comprising derived and/or modified sequence from Homo sapiens__NP_004125.3 __HsHSPA9 (opt7)
gggagagucccgcagucggcguccagcggcucugcuuguucgugugugugucguugcaggccuuauucaagcuuaccaugaucagcgccuccagggcagccgcggcccggcuggugggcgcagccgcaagucgcgggcccaccgccgcgaggcaccaggacagcuggaacggucucucccaugaggccuuccggcuggucagucgcagggauuacgcaagcgaagccauuaagggcgccgugguagggaucgacuugggcacuaccaauuccugcguggcagucauggaggguaaacaagccaaggugcuggaaaacgcggagggggcccggacgacuccaagcguggucgcauuuaccgccgauggcgaacgccucgugggcaugccggcaaaaaggcaggccguaaccaaucccaacaauacuuucuaugccaccaagcggcugauugggcgcagguacgacgauccagaggugcagaaagacaucaagaacguccccuuuaagauugugcgggcguccaauggugaugcauggguggaggcccacggcaaauuguauaguccaagccagaucggggccuucguccugaugaagaugaaagaaacggcagagaacuaccucggccauacugccaagaaugcggugaucaccguacccgccuauuuuaacgacucccaacgccaggcaacuaaagaugccggucagauuagcgggcugaaugugcugagggucaucaacgaaccaaccgcagccgcccucgcauacggccuggacaagagugaggauaaagugauugccguguaugacuugggcggggguaccuucgauaucuccauucuggagauccagaagggcgucuuugaaguaaagagcacgaauggggacacuuuccucggcggugaggacuuugaucaagcgcugcugcggcacauugugaaagaguucaagcgcgaaaccggcguggacuugacuaaagauaacauggcccuccagaggguccgggaagcagccgagaaggccaaaugugagcuguccaguagcgugcagaccgacaucaaucugccguaccucaccauggauuccagcgggcccaagcaucugaacaugaaguugacucgcgcacaguuugaaggcaucgucacggaccugauuaggcggaccaucgcgccaugccaaaaagccaugcaggaugcagaggugaguaaguccgacauuggggaagugauccucguagguggcaugacuaggaugcccaaagugcagcaaaccguccaggaucuguucgggcgcgccccaagcaaggccgugaaccccgacgaggcagucgccauuggcgcggccauccaggguggcgugcuggcaggggaugugaccgacguauugcuccuggacgugacuccgcugagucucggcaucgaaacgcugggcggggucuucaccaaauugauuaaucggaacacuaccauccccaccaagaagucccagguguuuagcacugccgccgauggucaaacgcaggucgagauuaaagugugucagggggagagggaaauggcaggcgacaauaagcugcucggucaguucacccugaucggcauuccacccgccccacgcggggugccccaaaucgagguaacuuuugauaucgacgcgaacggcauuguccacgugagcgccaaagauaaggggaccggccgggaacagcagaucgugauucaguccaguggugggcugagcaaagacgauaucgagaauauggucaagaacgcagaaaaguacgccgaggaggacaggcgcaaaaaggaacggguggaggcagugaauauggccgaaggcauuauccacgauacugagaccaaaauggaggaguucaaggaccaauugccagcggaugaaugcaacaaacucaaggaagagauuuccaaaaugagggaacugcuggcccggaaggacagcgagacgggcgagaauauccgccaggcagccaguucccuccagcaggccagccugaaguuguuugaaauggcauauaaaaagauggccuccgagagggaagggagugguagcuccggcaccggggagcaaaaagaagaucagaaggaggagaaacagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4511 - RNA, 2375 nt, Artificial Sequence
  mRNA product Design3 comprising derived and/or modified sequence from Homo sapiens__NP_079291.2__HsHSPA12A (opt7)
gggagagucccgcagucggcguccagcggcucugcuuguucgugugugugucguugcaggccuuauucaagcuuaccauggccgacaaggaggcaggcgggagcgauggucccagggaaaccgccccaacuuccgcguacaguagcccggcccggucccugggcgacaccgggaucacgccccucaguccaagccacauugugaacgauacugacuccaaugucagcgagcagcaauccuuccuggugguaguggcagucgauuuuggcaccaccaguagcgguuaugccuacuccuucacuaaagaacccgagugcauccaugugaugaggcgcugggaagggggcgacccaggcgugagcaaccagaagacccccacgacuauuuugcugaccccagagcggaaauuucacaguuucggguaugcagcccgcgauuuuuaccaugaccucgauccgaaugaggcgaagcaguggcuguauuuggaaaaauucaagaugaagcugcacacuaccggugaccucaccauggauacggaccugacugccgcaaacggcaaaaaggucaaagcccuggagaucuuugccuacgcacuccaguauuucaaggaacaagcccugaaagaguuguccgaucaggcggggagcgaguuugaaaauuccgacgugagguggguaauuaccgugcccgccaucuggaagcagccagcaaaacaguucaugcggcaagccgcauaccaggccggccuggccagucccgagaacagcgaacagcucaucauugcgcuggagccagaagcagccuccaucuacugucgcaagcugagguugcaucagaugauugagcucagcaguaaggccgcagucaaugguuauuccgggagcgacacugugggcgccggcuuuacccaagcgaaagagcacauccggcgcaacaggcagagucggaccuuccugguggaaaaugucauuggggagaucugguccgaacuggaggaaggugauaaguacgugguaguggacagcggcgggggcacugucgaucucacggugcaccagauucgccugcccgagggucauuugaaagagcuguauaaggccaccggcgggccguacggcagccucgggguggacuaugaguucgaaaaacugcuguacaagaucuuuggugaagauuucaucgagcaauuuaagauuaaaaggcccgcagccugggucgacuugaugaucgcauucgaaucccggaagcgcgccgccgcaccagauaggacuaacccccucaauauuacccugccauuuaguuucaucgacuauuacaaaaaguuucggggccacagcguggagcaugcccugcgcaaauccaacguagauuucgugaaguggagcagucaggggaugcucaggaugucccccgacgcgaugaaugcccuguuuaagccaaccauugauagcaucaucgagcacuugcgggaccuguuccagaaaccggaagucuccacugugaaguuucucuuccuggucggcgguuuugcagaggcaccccuguugcagcaagccgugcaggccgcguucggcgaccagugcaggauuaucauuccacaggauguggggcucacgauccugaaaggcgccguacuguucgggcucgaccccgcagugauuaagguccgccggaguccacugaccuacggcgugggugucuugaacagguauguggaagggaaacaucccccggagaagcugcucgugaaggauggcacucgcugguguaccgacguauuugauaaauucaucagcgccgaccaauccguggcccugggugagcuggucaagcggagcuacaccccagcaaaacccagucaguuggugaucgucauuaauaucuauuccagcgaacacgauaacguguccuuuauuacugaccccggcgugaagaaaugcgggacgcugaggcucgaucugaccggcaccagugggacugccguaccagcgcgccgggagauccagacucucaugcaguucggcgacaccgaaauuaaggccacggcaaucgauauugccaccagcaaauccgucaagguggguaucgacuuucugaacuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4512 - RNA, 2408 nt, Artificial Sequence
  mRNA product Design3 comprising derived and/or modified sequence from Homo sapiens__NP_443202.3 __HsHSPA12B (opt7)
gggagagucccgcagucggcguccagcggcucugcuuguucgugugugugucguugcaggccuuauucaagcuuaccaugcuggccgugcccgagaugggccuccaggggcuguacaucgguagcuccccagaaaggaguccgguccccagcccacccggcuccccacggacccaagagaguugcgggauugcacccuugacuccaagccaguccccgaagcccgaagugcgcgccccacagcaggcgagcuucuccguaguggucgccaucgacuuuggcaccacgaguagcgguuaugcauucuccuuugccagcgaucccgaggcaauucacaugaugaggaaaugggaagggggcgacccaggcguggcccaucaaaagacucccaccugucugcuccugaccccggagggggcguuccacaguuuugguuacacugcccgggauuauuaccaugacuuggaucccgaggaagcacgcgacuggcuguauuucgagaaauuuaagaugaaaauccacuccgccaccgaucucacgcugaagacucagcuggaagccgugaacggcaagaccaugccagcacucgaggucuucgcccaugcgcugagguuuuuccgggagcacgccuugcaggaacugcgcgagcagagccccucccucccagaaaaagacacugugagguggguacugaccgugcccgcaauuuggaagcaaccagccaaacaguuuaugcgggaggcagccuaccuggccggguuggucagucgcgaaaaugcggagcagcuccugaucgcacuggagccggaagccgccagcguguauugcaggaagcuccggcugcaccaguugcuggaucucuccggccgcgcacccggugggggcaggcugggcgagcggcgcagcaucgacaguuccuucaggcaagcccgggaacagcugcgcaggagccggcauaguaggaccuucuugguggaguccggggucggugaacucugggcggagaugcaggccggcgaucgcuacgugguagcagacugugggggcgguacgguggaucugacuguccaccaacuggagcagccacauggcacccucaaagaacuguacaaggccagcgggggccccuauggggcaguggguguggacuuggccuuugagcagcugcucugccggauuuucggcgaagacuuuaucgccacuuucaaaaggcagcgcccagcagccugggucgaucugaccauugcguuugaggcccggaagaggaccgcagggccccaccgcgccggcgcccugaacaucagcuugccguucuccuuuauugacuucuaccggaagcaaaggggucacaauguggaaacugcacuccggcgcaguagcguaaacuuugugaaaugguccagccagggcaugcugaggaugaguugugaggcgaugaaugagcuguuccagccaacggucuccgggaucauucagcauaucgaagcccuccuggcacggcccgaggugcaaggcgucaaguugcuguuucucguagggggcuucgccgaaagcgccgugcugcagcacgcagugcaggccgcgcugggugcccgcggguugaggguggucgugccccaugaugucggccugaccauccucaaaggugcagugcuguuuggccaggccccaggggugguacgggugcgcaggaguccccucacuuauggcgucggggugcugaaccgguucgucccaggcaggcacccgcccgagaaguugcuggugcgcgacggucggagguggugcaccgauguguucgagcgcuuuguagccgcagaacaauccgucgcccucggggaggaagugcggaggagcuacuguccagcgcgccccggccagcggagggugcugauuaaucuguauugcugugccgcagaggacgcccgcuucaucaccgauccaggcguccggaaaugcggggcauugucccuggaacucgagcccgccgacugcggucaggauacugcgggcgccccgccagggaggcgcgagauucgggcagccaugcaguuuggcgacacggaaaucaaggugaccgccguggauguaagcacuaacaggaguguccgcgcauccauugacuuccugagcaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4513 - RNA, 1763 nt, Artificial Sequence
  mRNA product Design3 comprising derived and/or modified sequence from Homo sapiens__NP_008879.3__HsHSPA13 (opt7)
gggagagucccgcagucggcguccagcggcucugcuuguucgugugugugucguugcaggccuuauucaagcuuaccauggccagggagaugaccauccugggcagcgcagugcucacucuguugcuggccggguaccucgcgcagcaauaucugcccuugccaaccccgaaggucauugguaucgaccugggcacgacuuacugcuccguggggguauucuuucccggcaccgguaaagugaaggucauuccagaugaaaacgggcacaucaguauucccagcaugguguccuucaccgacaaugauguguaugucggcuacgagaguguggaacucgccgacagcaacccacagaauacuaucuaugaugcaaaacgguuuaucggcaagauuuucaccgccgaggaacuggaggcagagaucgggcgcuaccccuuuaaaguacugaacaagaaugguaugguggaguucuccgucacgagcaacgaaacuauuaccguguccccagaauaugugggcaguaggcuccuguugaagcugaaagagauggccgaggcguaccucgggaugccggucgccaaugcagugaucagcguacccgccgaauuugaccugaagcagcggaacuccacuauugaggccgcaaaucuggccggcuugaaaauccuccgcgugauuaacgaaccaaccgcggccgcaauggccuacggucugcauaaggcagaugucuuccacgugcuggugaucgaccucgggggcggcacccuggaugucagcuugcugaauaaacaaggggguauguuucucacgagggccaugaguggcaacaauaagcucgggggccaggacuucaaccagcggcuguugcaguaucucuacaaacagaucuaucaaacuuacgguuuugugcccucccgcaaggaggaaauucauaggcugcggcaggccguagagauggugaagcugaaucucacccugcaccagagcgcgcaguuguccguccugcucacuguggaggaacaagaucgcaaagagccacauaguagcgacaccgaacugcccaaggauaaacuguccagcgcagacgaccacagggucaacaguggcuucgggcggggcuuguccgauaagaaaagcggggagagucaggugcuguucgaaaccgagaucucccgcaagcuguuugacacucugaacgaggaucucuuccagaagauucuggugccgauccaacagguauugaaagaaggucaccuggagaagacggaaauugacgaggugguccucgugggcgggagcaccaggaucccccggauccgccaggucauucaggaauuuuucggcaaagauccaaauacuagcguggaccccgaucuggccgugguaaccgguguggccauccaagcaggcauugacgggggcuccuggccacugcaggucagugccuuggagauccccaacaagcaucugcagaaaaccaauuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4514 - RNA, 1877 nt, Artificial Sequence
  mRNA product Design3 comprising derived and/or modified sequence from Homo sapiens__NP_057383.2__HsHSPA14 (opt7)
gggagagucccgcagucggcguccagcggcucugcuuguucgugugugugucguugcaggccuuauucaagcuuaccauggccgcaaucggcgugcaccuggggugcaccagcgccugugucgcgguguacaaggacgguagggccggcguaguggcaaacgaugccggggaccgggucacucccgcagugguggccuauuccgagaaugaagagauugucggccucgcggccaaacagagucgcaucaggaacauuagcaauaccgugaugaagguaaaacaaauccugggucgguccaguagcgauccacaggcacagaaguacauugccgaauccaaaugcuuggugaucgagaagaacgggaagcugcgcuaugaaaucgacacgggcgaggagacuaaauucgucaauccggaagauguggccaggcucauuuuuagcaagaugaaagagaccgcacauuccgugcugggcagugacgccaacgaugucgugaucaccguacccuucgacuuuggggaaaagcagaaaaaugcguugggugaggccgcacgggccgcaggcuucaacgugcugcgccucauucacgagccaagcgccgcccugcuggcguacgggaucggccaagauucccccacugguaagagcaauauucucgucuuuaaacugggcgggaccaguuugucccugagcgugauggaagugaacuccggcaucuauaggguccucaguacgaauacugacgauaacauugggggugcacauuucaccgagacucuggcccaguaccuggccagcgaauuucagcgguccuucaagcacgacgugcgcggcaaugcaagggccaugaugaaguugaccaacagcgcggagguagccaaacauagucucuccacccuggggagcgcaaauuguuuucuggauagucucuaugaaggccaggacuucgacugcaacgugucccgggcccgcuuugagcuguuguguagcccacuguucaacaagugcaucgaggcaaucaggggucuccuggaucaaaauggcuucacggccgacgauauuaacaaagucgugcugugugggggcagcucccggauccccaaguugcagcagcucauuaaagaccuguuuccagccgucgaacugcucaauaguaucccgcccgaugaggugauuccaaucggggcagccaucgaagcggguauucugaucggcaaggagaacuugcugguggaagacagccucaugauugagugcuccgcccgcgauauccugguaaaggggguggacgagagcggcgcaaguagguucacuguccuguuucccuccgguaccccauugcccgcccggcgccagcacacucuccaagccccgggcagcauuuccagugugugucuggaacuguacgagagcgaugggaaaaauuccgcaaaggaagagaccaaauucgcgcaggucgugcuccaggaccuggauaagaaagaaaacggcuugagggacauccuggccgugcucaccaugaagcgggacgggagccugcacguaacuugcacggaucaagagaccggcaagugcgaggcaaucaguauugaaaucgccuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4515 - RNA, 2924 nt, Artificial Sequence
  mRNA product Design3 comprising derived and/or modified sequence from Homo sapiens__NP_006635.2 __HsHSPH1 (opt7)
gggagagucccgcagucggcguccagcggcucugcuuguucgugugugugucguugcaggccuuauucaagcuuaccaugagcguggucggccuggacguggggucccagaguugcuacaucgccguagcaagggccgguggcauugaaaccaucgcgaacgaguucagcgaucgguguacucccuccgugauuaguuuugggagcaagaaucgcaccaucggcgucgccgccaaaaaccaacagauuacgcacgcaaauaacacuguguccaauuucaagagguuucauggucgggcauucaacgacccauuuauccagaaagagaaggaaaaucucagcuaugaucuggugccguugaaaaacgggggcgucggcaucaaggugauguacaugggggaggaacaccuguucuccguagagcagauuaccgccaugcuccugaccaaguugaaagagacugcggaaaauagucugaagaaacccgugaccgacugcgucaucagcgugccauccuuuuucacggaugccgagcgcaggagcgugcucgacgcagcccaaauugucggucugaacugucugcggcucaugaaugauaugacugccguggcacugaacuauggcaucuacaagcaggacuugcccagucuggaugaaaaaccacgcauuguaguguuugucgacauggggcauuccgccuuccaggugagcgcgugcgccuuuaauaagggcaaacucaaggugcuggguaccgcauucgaucccuuccugggcgggaagaacuuugacgagaaauuggucgagcacuucugugccgaauuuaagacuaaauauaagcucgaugcaaaauccaagaucagggcccugcugcggcucuaccaggagugcgaaaagcugaaaaaguugaugaguagcaauuccaccgaccugccacucaacauugaguguuucaugaacgacaaagaugugagcggcaagaugaaucgcagucaauuugaagaacugugcgccgagcuguugcagaaaaucgaaguaccgcucuauucccugcuggagcagacccaucucaagguggaagacgucagcgcgguggagaucgucgggggugcaacgaggauucccgccgugaaggaacggaucgccaaauucuuuggcaaggauauuaguacuacccugaacgcagacgaggccguggcgcgcgggugugccuugcagugcgcaauccuguccccagccuucaaaguaagggaguuuagcgugacugaugcaguccccuucccaauuagccucaucuggaaucacgacuccgaagauaccgagggcgugcacgaagucuuuagucggaaccaugccgcccccuucagcaaggugcugaccuuucugcgcagggguccguucgaguuggaagcauucuacuccgacccccaaggcgugccauaccccgaggccaaaaucgggcgguuuguagugcagaaugucagcgcgcagaaggauggcgagaagagucgcgugaaagucaaggugagggugaacacucacgggauuuucacgaucuccaccgccagcaugguagaaaaagucccaacugaggaaaaugagauguccagugaggcagacauggaaugccucaaccaacggcccccagagaauccggauaccgacaagaacgugcagcaggacaauagcgaagccgguacccagccccaagugcagacugaugcccagcagacgucccaaagcccacccaguccagagcugaccuccgaagagaacaaaauucccgacgcagauaaggcgaaugagaaaaaggucgaccagccgccagaagccaagaaacccaagaucaaaguggugaacguagagcugcccauugaagcaaaucucgucuggcagcugggcaaggauuugcugaacauguauaucgagacugaagggaaaaugaucaugcaggacaagcucgagaaggagaggaacgaugccaaaaaugccguggaagaguacguguaugaauuucgcgacaagcuguguggcccauacgagaaauucauuugcgaacaagaucaucagaacuuucugcgguugcugaccgagaccgaggacuggcucuaugaagagggugaagaucaggcaaagcaggccuacgucgacaaacuggaggagcucaugaagaucggcacucccgugaagguaagguuccaagaagcggaggaacgcccaaaaauguuugaggaacuggggcagcgguugcagcacuaugccaagauugcagccgauuucaggaauaaagacgagaaguacaaccacaucgacgagagcgaaaugaaaaagguggagaaauccgucaaugaagugauggaguggaugaacaaugugaugaacgcccaagcaaagaagagucuggaucaggacccggucgugcgcgcccaggaaauuaaaacgaagaucaaagagcucaauaacaccugugagcccguagugacucagccaaagcccaaaauugaaagcccaaagcuggagcggacccccaauggcccgaacaucgauaagaaagaagaggaccuggaggauaagaauaacuuuggggcggaaccaccccaucaaaauggcgagugcuacccaaacgagaaaaacuccgucaauauggacuuggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4516 - RNA, 3347 nt, Artificial Sequence
  mRNA product Design3 comprising derived and/or modified sequence from Homo sapiens__NP_006380.1 __HsHYOU1 (opt7)
gggagagucccgcagucggcguccagcggcucugcuuguucgugugugugucguugcaggccuuauucaagcuuaccauggccgacaaggugaggcggcagcgccccaggcggcgcgucugcugggcacugguggccguacuccuggcggauuugcuggcccucagcgacacccuggcagugauguccgucgauuugggcagugagagcaugaaaguggccaucgugaagccaggggucccgauggaaauugugcugaacaaagaguccaggcggaagacucccguaaucgugacccucaaagaaaaugagcgcuucuuuggugacagugcagccagcauggcgauuaagaacccaaaggccacgcugagguacuuccaacaucugcucggcaaacaggcagauaauccccacgucgcccuguaucaggcccgguuuccagaacacgaguugacuuucgacccccagcgccaaaccgugcauuuucagaucuccagccagcugcaguucuccccagaggaagugcucgggaugguccugaacuacaguaggagccuggcagaggauuuugccgaacaaccgauuaaggacgcggugaucaccguacccguguucuuuaaucaggccgagcggcgcgcagucuugcaggccgcaaggauggccggccucaaagugcugcagcugaucaacgauaauacugccaccgcgcucuccuaugguguguuccggcgcaaggacauuaacacgacugcacaaaauaucauguuuuacgauauggggagcggcaguaccgucuguacuauugugaccuaucagaugguaaaaaccaaggaggccggcaugcagccacaacugcagaucaggggugugggguucgaccggacguugggcgggcuggaaauggagcuccgccugagggaacggcuggccggcuuguucaacgagcagaggaaaggucagcgcgcaaaggauguccgggaaaaucccagggccauggcgaagcuccugcgcgaggccaaccggcugaaaacugugcucuccgcaaaugccgaccacauggcacaaauugaggggcugauggacgaugucgacuuuaaggccaaagugaccaggguggaguucgaggaauugugcgccgaucuguuugagcgcguaccaggccccgugcagcaggcacuccagagcgccgaaaugucccuggacgagaucgagcaagucauucuggugggcggggcgacucgggucccgagggugcaggaaguguugcucaaggccguagguaaagaggaacugggcaagaacaucaaugcagaugaggccgccgcaaugggggcgguguaccaggccgcagcccugaguaaggccuucaaagucaagcccuuugugguccgggacgcagugguguauccaauccucguagaguucacccgcgaggucgaggaagaacccggcauucauagccugaaacacaacaagaggguguuguuuucccggauggguccauacccccagcgcaaagugaucaccuucaacagguacagccacgauuuuaauuuccauauuaacuauggcgaccugggguuucucggcccagaagaucugcgggucuucgggagucaaaaucugacuacggugaaguugaagggugugggcgacuccuuuaaaaaguacccggauuaugagagcaaagggaucaaggcccacuucaaccuggacgagaguggcguacucucccuggaccgcgucgaaagcguguucgagacccucguggaagauagcgcggaggaagaguccacucugaccaaauuggguaauaccauuaguagccuguuuggcgggggcacuacgcccgacgccaaggagaacgggaccgauacuguccaggaagaggaagaguccccagcagaaggcagcaaggacgagcccggugaacagguggaacucaaagaggaagccgaggccccaguagaagaugggagucagcccccgccacccgagcccaagggcgacgcaaccccagagggugaaaaagccaccgagaaggaaaauggcgauaaauccgaggcgcaaaagcccagcgagaaagccgaagcagggccagagggcguggccccggcacccgaaggggagaagaagcagaaaccagccaggaagcggaggauggucgaagagaucggcguggagcuggugguccuggacuugcccgaucugccagaagacaaacucgcgcaguccgugcaaaagcugcaggaucucacucugcgcgacuuggagaaacaggaacgggagaaggccgcaaacagucuggaagccuucaucuuugagacgcaggauaagcuguaccaacccgaguaucaggaaguaagcaccgaggaacagagggaggagauuuccgguaaacucagcgccgcaaguacuuggcuggaagacgagggggugggcgccaccacugucauguugaaggaaaaacuggcggagcuccgcaagcugugucagggccucuucuuucggguggaagagaggaaaaaguggccggagcgccuguccgccuuggacaaucugcugaaccauagcuccauguuccucaagggggcacggcugaucccagaaauggaucaaauuuuuaccgagguggaaaugacgaccuuggagaaagucaucaaugaaacuugggccuggaagaacgcaacccuggccgagcaggccaaacuccccgcaacugagaagccagugcugcugaguaaagacauugaagcgaagaugauggcccucgauagggagguacaguaccuguugaauaaagccaaguucaccaagccccgcccgcggcccaaagacaagaacgguacgagggcagaaccaccccugaaugccagcgcauccgaucagggcgagaaagugaucccacccgccgggcaaaccgaagacgcggagccaaucagcgagccggaaaaggucgagacuggcagugaacccggugauaccgagccacucgagcugggcgggcccggcgccgaaccagagcagaaagaacaguccacugggcaaaagcgccccuugaagaacgacgagcugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4517 - RNA, 2546 nt, Artificial Sequence
  mRNA product Design3 comprising derived and/or modified sequence from Homo sapiens__NP_005339.3 __HsHSP90AA1 (opt7)
gggagagucccgcagucggcguccagcggcucugcuuguucgugugugugucguugcaggccuuauucaagcuuaccaugcccgaggaaacccagacucaagaccagccaauggaggaagaggaaguggagaccuucgccuuucaggcagagaucgcccagcugaugagccucauuaucaacacguucuacuccaauaaggaaauuuuucugagggaguugaucaguaacagcuccgaugcgcuggacaaaauucgguaugaaagucucacugauccgagcaagcuggacuccggcaaagaguugcacaucaaucugauccccaacaagcaagaucgcacccucaccauugucgacacugggaucgguaugaccaaagccgaucugauuaauaaccugggcacgaucgcaaagagcgggacuaaggccuucauggaggcacuccaggccggcgcggacauuuccaugaucggucaguuuggggugggcuucuacagugccuaucugguagcagaaaaagugaccgucauuacuaagcauaaugaugacgagcaguacgccugggaaagcuccgccggcgggagcuuuaccgugaggaccgauacgggugagccaaugggccgggggacuaaagugaucuugcaccugaaggaagaccaaaccgaguaucucgaggaacgcaggaucaaagagauugucaagaaacauagucaguucaucggcuaccccauuacucuguuuguggaaaaggagcgggauaaggaaguauccgacgacgaggcagaggaaaaagaggauaaggaagaggaaaaagagaaggaggaaaaagagagcgaagacaagccagagaucgaggauguggguuccgacgaagaggaagagaagaaagauggggacaagaaaaagaaaaagaagauuaaagaaaaguauaucgaucaggaggagcugaacaaaaccaagcccaucuggacccgcaauccagacgauauuacuaacgaagaguacggcgaguucuacaaaaguuugacgaaugacugggaggaucaccucgccgucaagcauuuuagcguggaaggccagcuggaguucagggcgcuccuguucgugccgcggcgcgcccccuuugaccuguucgagaacaggaagaaaaagaauaacaucaaauuguauguccggcgcguguuuauuauggacaauugcgaagaacugaucccagaauaccucaacuucauuagggguguaguggauuccgaggaccugccccugaacaucagccgggaaauguugcaacagaguaagauccucaaagucauucgcaagaaucuggugaaaaagugucuggagcucuuuaccgagcuggcagaagauaaggagaacuauaaaaaguucuacgaacaguuuuccaaaaauaucaaguuggggauucacgaggacagccaaaacaggaaaaagcugagugagcuccugcgguauuacacuuccgccagcggcgaugaaauggugagccugaaggacuauugcacccgcaugaaagagaaucagaagcacaucuacuacauuaccggggaaacuaaagaucaggucgcaaacuccgccuucguggagagguugcggaagcauggccucgaaguaaucuauaugauugagccaaucgacgaguacugugugcagcaacugaaagaauuugaggguaagacgcuggucagugugaccaaggaaggccucgagcugcccgaagaugaggaggagaaaaagaaacaggaagaaaagaaaacuaaguucgagaauuugugcaaaaucaugaaggacauucuggagaagaaagucgaaaagguggugguaagcaacaggcucgugaccuccccguguugcaucgucaccagcacuuauggguggacggccaauauggagcgcauuaugaaagcgcaggcacugcgggauaacaguaccaugggcuacauggccgccaagaaacaccuggaaaucaaucccgaccauuccauuaucgagacuuugaggcagaaggcagaagccgauaagaacgacaaaagcgugaaggaccuggucauccuccuguaugagaccgcgcuccuguccaguggguuuagcuuggaggauccacaaacucacgccaaucgcauuuaccggaugaucaaacugggucucggcauugacgaagaugaccccaccgcagaugacacguccgccgcagugaccgaggaaaugccaccccuggagggggaugacgauacuagcaggauggaagagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4518 - RNA, 686 nt, Artificial Sequence
  mRNA product Design3 comprising derived and/or modified sequence from Homo sapiens__NG_005218__HsHSP90AA3P (opt7)
gggagagucccgcagucggcguccagcggcucugcuuguucgugugugugucguugcaggccuuauucaagcuuaccauggacagcuccaagcuggauaguggcaaagggcuccacaucaaccuggugcccaauaagcagaaccaaaccuugacuauugucgacaccaggaucgguaugacgaaaacugaucugauuaauaaccucggcaccgugaccaagagcgggacuaaagccuucauggaggcacugcaggccgacgcggauaucuccaugauuggccauuuugguguaggguucuacagugccuauuugguggcaaagaaggucaccgugaucagcaaacacaauaacgacgaacaguacacgugggaguccagcgccggcggcuccuuuacugugcggaccgaugaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4519 - RNA, 2522 nt, Artificial Sequence
  mRNA product Design3 comprising derived and/or modified sequence from Homo sapiens__NP_031381.2__HsHSP90AB1 (opt7)
gggagagucccgcagucggcguccagcggcucugcuuguucgugugugugucguugcaggccuuauucaagcuuaccaugcccgaggaagugcaccauggcgaggaagaggucgaaaccuucgccuuucaggcagagaucgcccaacugaugagccucauuaucaacacuuucuacuccaauaaggagauuuuucugagggaauugaucaguaacgcgagcgacgcccuggauaaaauucgguaugagucccucaccgacccaaguaagcuggauagcgggaaagaauugaagaucgacaucauuccgaauccccaggagcgcacgcugacucucguggauaccgguaucggcaugaccaaagcagaccugauuaacaaucuggggacuaucgccaaguccggcaccaaggcauucauggaggcccuccaggcgggugccgauauuagcaugaucgggcaguuuggcguaggcuucuacuccgcauaucugguggccgaaaaagucguggugauuacgaagcacaacgacgaugagcaauacgccugggaaaguagcgcaggggguuccuuuacugucagggccgaccauggcgagccaaucgggcggggcaccaaagugaucuugcaccugaaggaagaucagacugaguaucucgaggaacgcaggguaaaagagguggucaagaaacauagccaguucauugguuaccccaucacccuguaucuggaaaaggagcgggaaaaggagauuagugacgaugaggcggaagaggaaaaaggggagaaggaagaggaggacaaagacgaugaagagaagccaaaaaucgaagacgugggcuccgaugaggaggacgauagcggcaaggacaagaaaaagaaaaccaagaaaauuaaggaaaaguacaucgaucaggaggaauugaauaaaacgaagcccaucuggacucgcaacccagacgauauuacccaagaggaauacggggaguuuuauaaaucccucacuaaugacugggaggaucaccuggccgugaagcacuucagugucgaaggucagcuggaguuuagggcacuccuguucaucccgcggcgcgcccccuucgacuuguuugaaaacaaaaagaagaaaaauaacauuaagcuguacgugaggcggguauucaucauggacagcugcgaugagcucauuccagaauaucugaauuuuauccgcggcguggucgacuccgaggaucugcccuugaacaucagcagggagaugcuccagcagaguaaaauucugaaggugauccggaaaaauauugugaagaaaugucuggaacucuucuccgagcuggcagaagacaaggagaacuacaagaaauuuuaugaagccuucagcaagaacuugaaacuggggauccaugaggauaguaccaaucgcaggcggcucuccgagcugcugcgcuaccacaccagccaaagcggcgacgaaaugacuuccuugagugaguaugucagcaggaugaaggaaacgcagaaauccauuuacuacaucaccggugagagcaaggaacagguggccaacagugcguuuguagagcgggugaggaagcgcggcuucgaggucguguauaugacugaaccaauugaugaguacugcguccaacagcucaaagaauuugacgggaagucccuggugagcgugaccaaagagggccuggagcuccccgaagaugaggaagagaagaaaaagauggaagaguccaaggcaaaauucgagaaucuguguaaguugaugaaagaaauccuggacaagaaaguagagaaggugaccaucaguaaccggcucgucagcuccccgugcuguauugugacuagcacguauggguggaccgccaauauggaaaggaucaugaaagcccaggcacugcgcgauaacaguacuauggguuacaugauggccaagaagcaucuggagauuaaucccgaccacccaaucgucgagaccuugcggcagaaagcggaagccgauaagaacgacaaagcagugaaggaccuggugguacuccuguuugagaccgcccuccuguccagcggcuucuccuuggaagauccccaaacucacaguaauaggauuuaucgcaugaucaaacuggggcucggcaucgacgaggaugaaguggcagccgaggagccaaacgccgcaguccccgacgaaauuccaccgcuggagggugaugaagacgccagccggauggaggaaguggauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4520 - RNA, 2759 nt, Artificial Sequence
  mRNA product Design3 comprising derived and/or modified sequence from Homo sapiens__NP_003290.1__HsHSP90B1 (opt7)
gggagagucccgcagucggcguccagcggcucugcuuguucgugugugugucguugcaggccuuauucaagcuuaccaugagggcccugugggugcucggccugugcugugucuugcugaccuucgggagcgugcgggcagacgaugagguagacguggaugguacugucgaagaggaccucggcaagucccgcgaagggaguaggaccgaugacgagguggugcagcgggaagaggaggccauccaacuggauggcuugaacgcgagccagauucgcgaacugagggagaaauccgaaaaguuugccuuccaggcagaggucaaucggaugaugaaacucaucauuaacagucuguacaagaauaaagagaucuuucugcgcgaacucauuagcaacgccuccgacgcacuggauaagaucagguugaucagccugacggacgagaaugcccucuccgguaacgaagaacugacugugaagauuaaaugcgauaaggagaaaaaucuguugcacguaaccgacaccggggugggcaugacucgggaggagcucgucaagaaccugggcaccaucgcgaaaagugggacgagcgaguuccugaauaagaugacugaggcccaggaagauggucaauccaccagcgagcucauuggccaguuuggggugggcuucuauagugcauuucugguggccgacaaagucaucgugacuuccaagcauaacaaugacacccagcacauuugggaaagcgauuccaacgaguucaguguaaucgccgacccccgcgguaauaccuuggggaggggcacgacuauuacccuggugcucaaggaggaagcaagcgauuaccuggagcuggacacuaucaaaaacuuggucaagaaauauucccaguuuaucaauuucccaauuuacguguggagcaguaagaccgaaaccguggaggaaccgauggaggaggaagaggccgcgaaagaagagaaggaggaauccgaugacgaggccgcagucgaagaggaagaggaggaaaagaaacccaagacuaaaaagguggagaaaacgguaugggauugggaacucaugaacgacaucaagccaauuuggcaacggcccagcaaggagguggaagaggaugaguauaaagccuuuuacaagaguuucuccaaagaaagcgacgauccaauggcauauauccauuucaccgccgagggcgaagucacuuuuaagagcauucuguucgugcccaccuccgccccacgcgggcuguuugacgaguacgguaguaaaaagagcgacuacaucaagcucuaugucaggcggguguucaucaccgaugacuuucacgauaugaugccgaaauaccugaacuucgugaagggcguaguggacuccgaugacuugccccugaaugucagccgcgaaacucuccagcagcauaaacugcugaaggugauuaggaaaaaguugguccggaaaacgcucgauaugaucaagaagauugcggacgauaaauauaacgacaccuuuuggaaggaguucgggacuaauaucaaacugggcgugauugaggaucacaguaaccgcaccaggcuggcaaagcuccugcgguuucaguccagccaccauccaaccgacaucacuuccuuggaucaauacguggaaaggaugaaagagaagcaggacaagaucuauuucauggccgguaguagccgcaaagaagccgaguccagccccuuuguagagcggcugcucaagaaaggcuacgaagugauuuaucugacggagccagucgacgaauacuguauccaggcacugcccgaguucgaugggaagagguuucaaaauguggccaaagaaggcgucaaguucgacgagagugagaagaccaaagaaucccgcgaggcgguggaaaaggaguucgaaccguugcugaacuggaugaaagauaaggcccucaaagacaagauugagaaagcagugguaagccagcggcugacugagucccccugcgcccucgucgcaagucaguacggguggagcgguaauauggaaaggaucaugaaggcccaggccuaucaaaccggcaaggauauuuccacuaacuacuaugcaagccagaaaaagaccuuugagaucaauccacgccacccccugauucgggacauguugaggcggaucaaagaagaugaggacgauaagacggugcuggaccucgccgugguccuguucgagaccgcgacucugcgcaguggguacuugcugccagauaccaaagccuauggcgacaggaucgaacggaugcuccgccugucccucaacauugaccccgaugcaaagguggaggaagaaccagaagaggagccggaagagacugccgaagacaccacggaggauaccgaacaggacgaggaugaggaaauggacguggguacugaugaggaagaggaaaccgccaaggagagcacugcagagaaagacgaacugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4521 - RNA, 2462 nt, Artificial Sequence
  mRNA product Design3 comprising derived and/or modified sequence from Homo sapiens__NP_057376.2__HsTRAP1 (opt7)
gggagagucccgcagucggcguccagcggcucugcuuguucgugugugugucguugcaggccuuauucaagcuuaccauggccagggagcugcgggcacuccuguuguggggccgcaggcugcggccccuccugcgcgccccagcguuggccgcagugcccggggguaagccgauccugugcccaaggcggaccacugcccagcucggcccccgcaggaacccagcauggagccugcaagccgggcggcuguucuccacccagacggcggaagacaaagaggaaccccuccacaguauuaucagcuccacugagaguguccagggcagcaccuccaagcaugaauuucaggccgagaccaaaaagcuguuggauauuguggcacgcagccuguacuccgagaaagaaguauucaucagggagcucauuaguaaugccagcgacgcccuggaaaagcugcggcacaaguugguguccgauggucaagcacucccagagauggagauccaucugcagacuaacgccgaaaaagggaccaucacgauucaggacacuggcaucggcaugacccaggaggaacuggucagcaaucucgggacuauugcgcgcagugguuccaaggccuuucuggaugcauugcaaaaccaggccgaggcaagcuccaaaaucauuggccaguucggggugggcuuuuauagugccuucaugguggccgacagggucgaaguguacagccgguccgcggcaccggguagccugggguaucaguggcucagugauggcuccggcguauuugagaucgccgaggccagcggggugcgcaccgguaccaagauuaucauccaccugaaaagugacuguaaggaguucuccagcgaggcaaggguccgggauguggugacgaaauacagcaauuuugucuccuucccccuguauuugaacggccgcaggaugaauacucuccaagccauuuggaugauggacccaaaggaugugcgggaauggcagcaugaggaauuuuacagguauguagcgcaggcccacgacaagccccgcuacacccugcacuacaaaacugaugcaccacugaacauccggaguauuuucuaugugcccgacaugaagccgagcauguucgacgucuccagggagcucgggagcaguguggcccuguacucccgcaaaguguugauccaaaccaaggcaaccgauauucugcccaaauggcuccgguuuaucaggggcgucguggacagcgaggauaucccacugaaucugucccgcgaauugcuccaggagagugcccugauucggaagcugagggacguacuccagcagcggcugaucaaguucuuuauugaucaaagcaaaaaggacgccgaaaaauaugcaaaguucuuugaggauuacgguuuguucaugcgcgaaggcaucgugacugccacggagcaggaggucaaagaagacauugcgaagcugcucagguaugaguccagcgcccugcccagugggcagcugaccuccuugagcgaauacgcaucccggaugcgcgccggcacuaggaacaucuauuaccugugcgccccaaaucggcaucucgcagagcacagucccuacuaugaggcgaugaagaaaaaggauaccgaagugcuguuuuguuucgagcaguuugacgaacucacccuguugcaucugcgcgaguucgauaaaaagaaacucaucagcgucgaaacugacauugugguggaccacuacaaggaggagaaguuugaagauagguccccagccgcagagugccugagcgaaaaagagacggaagaacugauggccuggaugcggaacguauuggggaguagggugaccaaugucaaggugacucugcgccucgacacccacccggccauggucaccgugcuggagaugggugcagcccggcauuuccucaggaugcaacagcuggcgaaaacucaggaggaacgcgcccaguugcugcaacccacgcuggaaaucaacccacggcacgcacucauuaagaaacugaaucaguugagggccuccgagcccggccuggcccagcuccugguggaucagaucuaugaaaacgcaaugauugccgcggggcucguagacgauccacgcgccauggugggccggcugaacgaguugcuggucaaggcacuggagaggcauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4522 - RNA, 809 nt, Artificial Sequence
  mRNA product Design3 comprising derived and/or modified sequence from Homo sapiens__NP_000609.1__HsIGF1 (opt7)
gggagagucccgcagucggcguccagcggcucugcuuguucgugugugugucguugcaggccuuauucaagcuuaccaugggcaagaucagcucccugcccacccaacucuucaaaugcuguuuuugcgacuuccugaaggugaaaaugcacacuaugaguagcucccauuuguuuuaccuggcccucugucuguugaccuucacgaguagcgcaacugccgggccagagacccugugcggugcggaacucgucgaugcccugcaguuuguguguggcgacaggggguucuauuuuaacaagccgaccggcuacgguuccagcucccggcgcgcaccccagacugggauuguagaugagugcuguuucaggaguugcgaccugcggcgccucgaaauguauugugccccacugaaacccgcaaagagcgccagguccgugcgggcgcagcgccacaccgauaugccaaagacgcagaaagagguccauuugaagaaugccagcaggggcagugcaggcaacaaaaauuaccggaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4523 - RNA, 890 nt, Artificial Sequence
  mRNA product Design3 comprising derived and/or modified sequence from Homo sapiens__NP_000603.1__HsIGF2 (opt7)
gggagagucccgcagucggcguccagcggcucugcuuguucgugugugugucguugcaggccuuauucaagcuuaccaugggcauccccauggguaagagcaugcuggugcuccugaccuucuuggccuuugcauccugcuguauugccgcguacaggccaagugagacucugugcgggggcgaacucgucgacacccugcaguucguguguggggaucggggcuuuuauuucagccgcccggccuccaggguaagucggcgcagcagggguaucguggaggaaugcuguuuucgguccugcgacuuggcacugcucgagacguacugugccacucccgcaaaaagcgaacgcgaugucuccaccccacccaccgugcugccagacaacuuccccagguauccaguggggaaguuuuuccaauacgauacuuggaaacagaguacccagcggcugcgcaggggccucccggcccuguugcgggcgcgcaggggccacguccuggccaaggagcucgaggcauuucgggaagccaaacgccauaggccccugauugcccugccaacgcaggaccccgcacacgggggugccccacccgagauggcgagcaaucggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4524 - RNA, 986 nt, Artificial Sequence
  mRNA product Design3 comprising derived and/or modified sequence from Homo sapiens__NP_000591.1__HsIL6 (opt7)
gggagagucccgcagucggcguccagcggcucugcuuguucgugugugugucguugcaggccuuauucaagcuuaccaugaacagcuucuccaccagugccuuuggccccguggcauucagccuggggcuccuguugguccugccagccgcguuuccggcccccgugccacccggugaggacuccaaggauguagcagccccacacaggcagccccucaccaguagcgaacggaucgacaaacaaauucgcuacauccuggauggcauuuccgcauugaggaaggagacuugcaauaaaagcaacaugugugaauccaguaaggaggcccuggcggaaaauaaccucaaucugccaaaaauggccgagaaggacgggugcuuccagagcggcuuuaacgaggaaacgugucuggugaagaucauuacuggucuccuggaguucgaagucuauuuggaguaccugcagaaucgguuugaguccagcgaagaacaggcacgcgccgugcaaaugaguaccaaagugcucauccaguuccugcagaagaaagccaagaaccuggaugcaaucaccacuccggaccccaccacgaaugccuccuugcucacuaaacugcaggcgcaaaaccaguggcugcaggauaugaccacucaucucauucugaggagcuuuaaggaguucuugcaguccagucugcgggcccuccgccaaaugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4525 - RNA, 1628 nt, Artificial Sequence
  mRNA product Design3 comprising derived and/or modified sequence from Homo sapiens__NP_002183.1__HsINHBA (opt7)
gggagagucccgcagucggcguccagcggcucugcuuguucgugugugugucguugcaggccuuauucaagcuuaccaugccccugcucuggcugaggggcuucuugcuggccagcugcuggaucauugugcgguccaguccaaccccggggagcgagggucacuccgcagcccccgacuguccaaguugcgcgcucgccgcacugcccaaggaugucccaaacagccagcccgaaaugguggaggccgugaaaaagcauaucuugaauaugcugcaccucaaaaagcgcccagacguaacucaaccgguccccaaagcagcccugcugaacgcgauuaggaagcuccaugugggcaaggugggggaaaauggcuacgucgagaucgaagaugacauuggucggcgcgccgagaugaacgagcugauggaacagaccuccgagaucaucacguuugcagaaagcgggacugccaggaaaaccuugcacuucgagauuuccaaggagggcagugaucugagcgugguagaacgggccgagguguggcucuuucugaaagucccaaaggcaaaucgcaccaggacuaaagugaccauccggcuguuccagcagcaaaagcauccccagggcuccuuggacacgggggaagaggccgaagaggugggucucaaaggcgagcgcagcgaacugcugcucagugagaaggucguggaugcgaggaaguccacuuggcacguauuuccagugagcuccaguauucagcggcuguuggaccaggggaaaagcucccuggauguccgcaucgccugugaacaaugccaggagagcggcgcaagucucgugcugcuggguaagaaaaagaaaaaggaagaggagggggaaggcaagaaaaagggcgggggugagggcggggccggcgcagacgaagagaaagaacagucccacaggcccuucuugaugcuccaggcccggcaaagcgaggaucauccgcaccgcaggcggcgcaggggucuggagugugacggcaaggugaacauuugcuguaaaaagcaguuuuucgucaguuuuaaggauaucggguggaaugacuggauuaucgcccccuccggcuaucaugcgaacuacugcgaaggggaguguccaagccacaucgcagguaccagcggcuccagucugagcuuccacuccacugugauuaaucauuaucggaugagggggcacagccccuuugccaaccucaaaaguugcugcguaccaaccaagcugcgccccauguccauguuguacuaugacgauggccagaauaucauuaaaaaggacauccaaaacaugauuguggaagagugugguugcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4526 - RNA, 1571 nt, Artificial Sequence
  mRNA product Design3 comprising derived and/or modified sequence from Homo sapiens__NP_002184.2__HsINHBB (opt7)
gggagagucccgcagucggcguccagcggcucugcuuguucgugugugugucguugcaggccuuauucaagcuuaccauggacggccugcccgggagggcccucggugcagccugccuguugcugcucgcggccggcuggcuggggccagaggcauggggcagcccgacucccccacccaccccagccgcacccccaccgcccccacccccagguucccccgggggcagucaggauaccuguacgagcugcggcggguuccggcgcccggaagaguuggguaggguggacggcgauuuucuggaagccgucaagcggcacauccucucccgccugcaaaugagggggcggcccaacauuacucaugcggugccaaaagccgcaaugguaaccgcccugcgcaagcuccacgccggcaaagugagggaggacggucgggucgaaaucccccaucuggaugggcacgcaaguccaggcgccgacggccaggagcgcgugagcgagauuaucuccuucgcggaaaccgauggguuggccagcuccagggugcggcuguacuuuuucauuaguaaugaggguaaccagaaucucuuugucgugcaggcaagccuguggcuguauuugaagcuccugcccuacguacuggaaaaaggcucccgcaggaaggugcgggucaagguguauuuccaagagcaggggcauggcgaccgcuggaacaugguggagaaaagggucgaucucaagcggagcgguuggcacacuuuuccacugaccgaagccauccaggcauuguucgagcgcggcgaaaggcggcugaaucucgacgugcagugugauaguugccaagagcuggccguagugccggucuuuguggaccccggggaagagucccacaggccauucguggucgugcaggcccgccugggcgauagccggcauaggauccgcaaacggggguuggagugugacgguaggacgaaccucugcugucgccagcaguuuuucauugacuuccggcugaucggcuggaaugauuggauuaucgcgcccacuggguacuauggcaacuacugcgaagguuccuguccagcauaucuggccggcguacccgggagugccagcuccuuucacaccgcaguggucaaucaauacaggaugcggggccucaacccggggacugugaauagcugcugcauuccaaccaagcugaguaccauguccauguuguacuucgacgaugaguauaacaucgucaaacgcgacgugcccaauaugauuguggaagaguguggcugcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4527 - RNA, 3806 nt, Artificial Sequence
  mRNA product Design3 comprising derived and/or modified sequence from Homo sapiens__NP_000623.2__HsITGAM (opt7)
gggagagucccgcagucggcguccagcggcucugcuuguucgugugugugucguugcaggccuuauucaagcuuaccauggcccugagggugcuccuguugaccgcacugacucucugccacggcuucaaccuggacaccgagaaugccaugacguuucaggaaaacgcgcggggguucggucaaagcgucgugcaguugcagggcucccgcguaguggucggggcgccccaggagaucguggcagccaaucaaaggggcagucuguaccagugugauuauagcacugguuccugcgaaccaauucggcuccaggugccggucgaggcagugaacaugagucuggggcugagccucgccgcgaccaccuccccaccccagcuguuggccuguggccccacuguacaucaaaccugcagcgaaaauacguacgugaagggccuguguuuucucuucggguccaaccugcgccagcagccacagaaauuucccgaggcacugagggguugcccacaagaggacagugauaucgccuucuugauugacggcagcggguccaucauuccgcacgauuuucggcgcaugaaggaguucgucagcacugugauggaacagcucaaaaagaguaaaacccuguuuucccugaugcaguauagcgaagaguucaggauccauuuuacuuucaaggaguuccaaaauaaccccaauccacggucccucgugaagcccaucacccagcuguugggccgcacccacacggccacugguauuaggaaagucgugcgggaacuguuuaacaucaccaauggggcacgcaagaacgccuucaaaauucucguagugaucacugacggcgagaaguuuggcgauccacugggguacgaagacgucauucccgaggcggauagggaaggugugauccgguaugugauuggcgucggggacgccuuccgcagugagaaaagcaggcaggagcugaauaccaucgcauccaagccgccccgggaucauguguuucagguaaacaauuucgaagccuugaaaaccauccaaaaccagcuccgcgagaagauuuuugcaaucgaaggcacucagacggguagcaguuccagcuucgagcacgaaaugagucaggagggcuuuuccgccgccauuaccagcaacgggccacugcugagcacugugggcuccuacgacugggccgggggugucuuccucuauaccaguaaggagaaaagcaccuuuaucaauaugacuaggguggauuccgacaugaacgacgcauaccugggcuacgccgccgcaauuaucuugcggaauaggguccaaagccuggugcucggggcgccccgcuaucagcacaucggccugguggccauguuccggcagaacacggguaugugggaaaguaaugccaacguaaagggcacccagauuggggcauacuuuggcgccucccuguguagcguggaugucgacuccaaugggaguacugauuuggugcucaucggcgcaccacauuauuacgagcaaaccaggggugggcaggucagcgugugcccccugccacgcggccgggccagguggcagugugacgccgugcuguauggugaacagggccaaccgugggggcgcuucggcgcagcccucaccguacugggggaugugaacggcgacaaauugacugaugucgcgauuggugcccccggggaggaagacaaucggggcgcaguguaccuguuccacggcacguccgggagcgguaucaguccaucccauagccagaggauugccggcuccaagcucaguccccggcugcaguauuuugggcaaagccuguccggcggucaggauuugaccauggacgggcuggucgaucucacugugggcgcccagggccacgugcugcuccugcgcagccagccaguauugagggucaaagcaaucauggaguucaacccccgggagguggcgcgcaauguguuugaaugcaacgaccaagucgugaaggggaaggaggccggugaagugaggguaugccugcacguccagaaaaguacccgggaccgccucagggagggccagauccaguccguggugacuuacgaucuggcacuggacagcgggcggccgcauuccagggccgucuucaaugagaccaagaacagcacgcgccggcaaacccagguguugggccugacucagaccugugaaacucucaaacugcagcucccaaauugcauugaggaucccguaagucccaucgugcugagguugaacuuuagccuggucgguaccccacuguccgccuucgggaaccuccgccccgugcuggcagaagacgcccaacgguuguuuacggcgcuguucccauuugagaagaauuguggcaacgauaauauuugccaggacgaucucaguaucaccuucagcuuuaugucccuggacugucucguggucggcgggccgagggaguucaacgugacuguaaccgugcgcaaugauggugaagacagcuaccggacucaggucaccuucuuuuucccccuggauuuguccuauaggaaagugaguacgcugcaaaaccagcgcagccagcgguccuggaggcuggccugcgagagugcaagcuccaccgaagugagcggcgcccucaagaguacuuccuguagcauuaaucacccaaucuuucccgagaacuccgaagucaccuucaauauuacuuuugacguggauagcaaggccagucuggggaacaaauugcugcucaaggcaaauguaaccuccgagaacaauaugccacgcacgaacaaaaccgaguuccagcuggaacugcccgugaaguacgccgucuauaugguggugacuagccauggcgucaguaccaaauaccucaauuuuacugcguccgagaacaccagccgggugaugcaacaccaguaucagguauccaaccugggucagaggagcuugccgaucagucugguguuccucgucccagugcgccugaaucaaacugugaucugggaccggccccaggucaccuuuagcgaaaacuuguccaguacgugccauaccaaggagaggcugccaagccacuccgacuuccucgccgaacugcgcaaggcacccgugguaaauuguagcauugccgugugccagaggauccagugcgauauuccguuuuucgggauccaagaggaauuuaacgcaacucugaaaggcaaucucuccuucgacugguacauuaagaccagucacaaccaucuguugaucgucagcacugccgagauccuguucaaugauuccguguuuacccuccugcccggccagggggcguucgugcggagccagacggagaccaaagucgaaccauuugaggugcccaacccauugccccugauuguagguaguuccgugggcgggcuccugcugcucgcccugaucacugcagccuuguauaagcugggcuucuuuaaaaggcaguacaaggacaugaugagcgaagguggcccaccgggggccgagccccaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4528 - RNA, 1751 nt, Artificial Sequence
  mRNA product Design3 comprising derived and/or modified sequence from Homo sapiens__NP_002415.1__HsMMP8 (opt7)
gggagagucccgcagucggcguccagcggcucugcuuguucgugugugugucguugcaggccuuauucaagcuuaccauguucagccugaagacccuccccuuucuguugcugcuccacgugcagaucuccaaagccuucccagucaguagcaaggagaaaaacacuaagaccgugcaagacuaccuggaaaaauuuuaucaguugccguccaaucaguaccagaguacgaggaagaacggcacuaauguaauuguggagaagcugaaagaaaugcaacgguucuuugggcucaacgucaccgguaagcccaaugaggaaacccuggauaugaugaaaaagccacgcugcggcgugcccgacagcgggggcuucaugcugacuccagguaaccccaaaugggagaggaccaaucucacguaucggauccgcaacuacacuccacagcuguccgaggcagaaguggagagggccauuaaggaugcguuugaauuguggagcgucgccuccccgcugaucuucacccggauuagucagggggaggcagacaucaauaucgccuuuuaucagcgcgaucauggcgacaacagccccuucgauggcccaaaugggauucucgcacacgccuuucaacccggucagggcaucgggggcgacgcgcauuucgaugccgaggaaacuuggaccaacaccuccgcaaauuacaaccuguuccugguggccgcccacgaguuuggucauagcuuggggcucgcacacaguuccgacccaggcgcccugauguaucccaauuacgcguucagggaaacgagcaacuacucccugccgcaggaugacauugauggcauccaggccauuuaugggcucaguagcaaccccauccaaccaacuggucccuccaccccaaaacccugugacccaagccugacuuuugacgcaauuaccaccuugcggggcgagauccuguucuuuaaggaucgcuacuucuggaggcggcacccgcagcuccagcgcguagaaaugaauuuuaucagucuguucuggcccucccugccaacugggauucaagccgcauaugaggacuuugauagggacuugaucuuccucuuuaagggcaaccaguacugggcccugagcgguuaugauauucugcagggcuaccccaaagacaucaguaauuauggguucccauccagcgugcaggccauugaugcggcagucuuuuaccggagcaagacguacuucuucgugaacgaccaauuuuggcgcuaugauaaucagaggcaguucauggagcccggcuacccgaaauccaucaguggggccuuuccagguaucgaaagcaagguggacgccgucuuccagcaagagcacuuuuuccauguguuuuccggcccccgguauuacgcauucgaucucauugcccagcgcguaaccaggguggcgcgggggaacaaauggcugaauugcagguauggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4529 - RNA, 2471 nt, Artificial Sequence
  mRNA product Design3 comprising derived and/or modified sequence from Homo sapiens__NP_004985.2__HsMMP9 (opt7)
gggagagucccgcagucggcguccagcggcucugcuuguucgugugugugucguugcaggccuuauucaagcuuaccaugagccuguggcagccccucgugcuggucuugcuggugcucggcugcuguuucgccgcaccaaggcaacggcaguccacccugguauuguuuccgggggaccugcgcacuaaccucaccgauaggcagcuggccgaggaauaccuguaucgguacgguuauacgcgcguggcggagaugaggggcgaaaguaagagccucgggcccgcccuguugcugcuccagaaacaacugucccugccagagacuggcgaauuggacagugcaacccucaaggccaugcggacccccaggugcggugucccagaucuggggagguuccagacuuuugagggcgaccugaaauggcaccaucacaauaucaccuacuggauucagaacuauagcgaggaucucccccgggcagugaucgacgaugccuucgcgcgcgccuuugcacugugguccgccgugacgccauugacuuucaccagggucuacagccgggacgccgauauugugauccaguuuggcguagcagaacauggggacgguuauccguucgauggcaaggacgggcugcucgcccacgcguuucccccaggccccgguauucaaggggaugcccauuucgacgacgaugagcuguggucccugggcaaaggcguggucgugccaacucgcuuugggaaugcagacggugccgcaugucacuuccccuucaucuuugaaggcaggaguuacagcgccugcaccaccgaugggcgguccgacggcuugccgugguguagcacgacugccaacuacgauaccgacgaucgcuucgguuuuugccccagugagaggcucuauacucaggacggcaaugcggaugggaagccaugucaguuccccuuuaucuuccagggccaauccuacagcgcaugcaccaccgacgggcgguccgaugguuaucgcuggugugccacuacggccaacuacgacagggacaagcuguuuggcuucugcccaacccgggcagauaguacugugaugggcgggaauagcgccggugagcugugcgucuuucccuucaccuuucucggcaaagaauauuccaccuguacuagcgaggggaggggcgacgggcgccuguggugcgcgacgaccaguaacuucgauuccgacaagaaauggggcuuuuguccagaucaggguuacagcuuguuccugguggccgcacacgaguucgggcaugcccucggccuggaccacaguuccguaccggaagcacugauguaucccauguaccgguuuacugaagguccacccuugcauaaggaugacgugaauggcauuaggcaccucuacgggccacgccccgagccggagccacggccacccaccaccacuacgccccagcccaccgccccaccgacugucugccccaccggcccacccacugugcacccaagcgaaaggcccaccgccgggccgacgggcccacccagcgcagguccaaccgggcccccgacugccggccccuccaccgcgacuaccgugccacugagucccgucgaugacgccuguaacgugaauaucuucgaugcaauugccgagaucggcaaccaacuguaucucuuuaaagacgggaaguacuggcgcuucagcgaaggucggggcuccaggccacaggggcccuuucugauugccgauaaauggccagcauugccgcggaagcuggacagcguauucgaggaacgccucaguaagaaacuguuuuucuuuuccggccgccaggugugggucuauacgggugcgagcgugcuggggccccggcgcuuggacaagcugggccucggcgccgaugucgcacaggugaccggggcccugagguccggucggggcaaaaugcuccuguucagugggcgcagguuguggcgguuugacgugaaggcccaaaugguagauccaaggagcgcauccgagguggaccgcauguuccccggcgucccacuggauacucaugacguguuccaguaccgggagaaagccuauuuuugccaggauagguucuacuggcgcgucagcagucgguccgaacucaaucagguggaccaaguggguuauguaaccuacgauauccugcagugucccgaggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4530 - RNA, 1763 nt, Artificial Sequence
  mRNA product Design3 comprising derived and/or modified sequence from Homo sapiens__NP_002418.1__HsMMP13 (opt7)
gggagagucccgcagucggcguccagcggcucugcuuguucgugugugugucguugcaggccuuauucaagcuuaccaugcaccccggcgugcuggccgcauuccucuuucugagcuggacccauugcagggccuugccacugccguccgggggugacgaggaugaccucagugaagaggaucugcaguucgcggaacgguacuugcgcagcuauuaccaccccacuaaccuggccggcauccucaaggagaaugcagccuccaguaugaccgaaaggcugcgggagaugcagagcuuuuucgggcuggaggucacgggcaaacucgacgauaacacucuggacgugaugaagaaaccacgcugugguguacccgaugugggggaauauaaugucuuuccaaggaccuugaagugguccaaaaugaaccugaccuaccggauugugaauuauacucccgacaugacccauagcgagguggaaaaggcauucaagaaagccuuuaaggucugguccgaugugacgccacucaacuucacucgccugcacgacggcaucgcggauauuaugaucaguuuuggcauuaaagagcauggggacuucuacccguuugauggucccagcggccuguuggcccacgcauucccacccgggccaaauuauggcggugacgcccacuucgacgaugacgagaccuggacuuccagcaguaagggguacaaccucuuucugguagccgcacaugaguucggccacucccugggccucgaucauagcaaagaccccggggcccugauguuuccgaucuacaccuauaccgguaagucccacuucauguugcccgaugacgaugugcaaggcauccagagucuguacgggccaggcgacgaggaucccaauccaaaacaccccaagacgccagacaagugcgauccgagccucucccuggacgcgauuacuagccugaggggugaaaccaugaucuuuaaagaccgguucuuuuggcgcuugcauccccagcaagucgaugccgaacucuuccugacuaagaguuuuuggccagaacugcccaacaggauugacgcagccuaugagcacccaucccaugaucucaucuucauuuuucggggccgcaaauucugggcacugaauggguacgacaucuuggagggcuaucccaagaaaauuagcgaacuggggcucccgaaggaggugaagaaaaucagugccgccgugcacuuugaagauaccgguaagacccugcuguucuccggcaaccaggucuggagguacgacgauacuaaucauaucauggacaaagauuauccacgguugauugaggaagacuuccccgggaucggcgauaagguggacgcgguauacgagaaaaacgguuacauuuacuuuuucaauggccccauccaguuugaguauagcauuuggagcaaccgcaucgugagggucaugccagcaaacuccauccucugguguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4531 - RNA, 1415 nt, Artificial Sequence
  mRNA product Design3 comprising derived and/or modified sequence from Homo sapiens__NP_001286.1__HsCCR1 (opt7)
gggagagucccgcagucggcguccagcggcucugcuuguucgugugugugucguugcaggccuuauucaagcuuaccauggagacccccaacacuaccgaagacuacgauacgacuaccgaguucgacuauggcgaugccaccccaugccagaaggugaaugaaagggcauuuggggcccaacugcucccgccccuguacagcuuggucuucgugaucggucugguaggcaacauucucgugguccugguguuggugcaguauaaacggcugaagaauaugacuuccaucuaccuccugaaccuggcgauuagugaccuccuguuuuuguucacccugccauuuuggaucgauuauaaacucaaggacgauugggucuucggggacgccauguguaaaauucugagcggcuuuuacuauacgggucuguacuccgagaucuucuuuaucauuuugcucacuaucgaucgcuaccuggcaauugugcacgccguauucgcacugagggcccggaccgugacuuuuggggucaucaccaguauuaucauuugggcgcucgccauccuggcaagcaugcccggcuuguauuucuccaagacccagugggaauuuacgcaucacacuugcagccugcauuuuccacacgagucccuccgcgaguggaagcuguuccaggcccugaaauugaaucucuuuggccuggugcugccccuccuggugaugaucauuuguuacaccgggaucauuaagaucuugcugaggcggccaaacgagaaaaagaguaaagccguccgccucauuuucgugaucaugaucauuuucuuccuguuuuggacuccguauaaucugaccaucuugauuagcguauuccaagacuuucucuucacccaugaaugcgaacaguccaggcaccuggaucuggcagugcaggucacugaggugaucgccuacacgcacuguugcgugaaccccgucauuuaugcguuugugggugagcgguuccgcaaguaccucaggcagcuguuucaucggcgcguagccgugcacuuggucaaauggcugccauuccucagcguggacaggcuggaacgggucaguuccaccagccccuccacuggcgagcaugaacugagugcaggguucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4532 - RNA, 983 nt, Artificial Sequence
  mRNA product Design3 comprising derived and/or modified sequence from Homo sapiens__NP_002598.4__HsPDGFA (opt7)
gggagagucccgcagucggcguccagcggcucugcuuguucgugugugugucguugcaggccuuauucaagcuuaccaugaggacccuggccugccuccuguugcugggcuguggguaccucgcacacgugcuggccgaggaagcggagaucccccgggaagucauugagcgcuuggccaggagccagauccauuccauucgggaccugcaacgccuccuggaaaucgauaguguggguagcgaggacucccuggauaccagucucagggcacacggcguacaugccacuaagcacgugccagagaaacggccgcugcccauucgcaggaagcggagcaucgaagaggcagucccagccgugugcaaaacgcgcacugugaucuaugaaauucccaggucccaggucgacccaaccagcgcgaacuucuugaucuggcccccauguguggagguaaagcggugcaccggguguugcaauacuuccagugugaaaugucagccgagccgcguccaucacagguccgugaagguggccaaggucgaguacgugcggaaaaagcccaaacugaaggaaguacaggugcgccucgaggaacaccuggagugcgcaugugccaccacgagccugaacccagauuauagggaagaggacacuggccggccccgcgagagugguaaaaagaggaaacggaagagguugaagccaaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4533 - RNA, 1073 nt, Artificial Sequence
  mRNA product Design3 comprising derived and/or modified sequence from Homo sapiens__NP_002599.1__HsPDGFB (opt7)
gggagagucccgcagucggcguccagcggcucugcuuguucgugugugugucguugcaggccuuauucaagcuuaccaugaacaggugcugggcccuguuccucagccuguguugcuacuugcggcugguguccgcagagggcgaccccaucccagaggaacucuaugaaaugcugagugaucacagcauucgcuccuuugacgauuugcagaggcugcuccauggggacccgggugaggaagauggcgccgagcuggaccugaauaugacccggagucacagcgggggcgagcucgaaucccuggcgcgcgguaggcggagcuuggggucccugacuaucgccgagcccgcaaugauugccgaauguaagacccgcacggaggucuucgagaucaguaggcggcucauugaucgcacuaacgcaaauuuucugguguggccacccugcguagaagugcaaagguguagcggcugcuguaacaaucggaacguccagugccgcccaacccaggugcagcugaggcccgugcaaguccggaaaaucgagaucgugcgcaagaaaccaauuuucaagaaagccaccguaacuuuggaagaccaucucgcguguaagugcgagaccguggccgcagccaggccggucacgcggucccccggcgggagccaggaacagcgcgccaagacuccacagaccagggugacuauccggaccgugaggguccgccggcccccaaaagguaagcacaggaaauuuaagcauacccacgauaaaacggcacugaaggagacucugggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4534 - RNA, 1385 nt, Artificial Sequence
  mRNA product Design3 comprising derived and/or modified sequence from Homo sapiens__NP_057289.1__HsPDGFC (opt7)
gggagagucccgcagucggcguccagcggcucugcuuguucgugugugugucguugcaggccuuauucaagcuuaccaugagccuguucggccuccuguugcugaccuccgcccucgcagggcagaggcaagguacucaggccgagaguaaccugagcuccaaguuucaguucaguagcaauaaagaacagaacggcgugcaagacccccagcacgagcggaucauuaccgucuccacgaaugggagcauccauuccccacgcuuuccgcacacuuaccccaggaacaccguguugguauggcggcugguggcggucgaagagaauguguggauucagcucaccuucgaugaacgcuuuggccuggaggacccagaggaugacaucugcaaguaugauuucguggaagucgaggaacccagugacgguacuauucuggggaggugguguggcagcggcaccgugccagggaaacagaucuccaaggguaaccaaauccggauucgcuuuguaagcgaugaguacuuccccagugagccaggcuuuugcauccauuauaauauugugaugccgcaguucacggaagccgucucccccagcgugcucccacccuccgcacugccauuggaccugcucaacaaugccaucacugcauuuaguacccuggaggaucugauuagguacuuggaacccgagcgguggcagcucgaccuggaagaucuguaucgcccgacuuggcagcuccuggggaaagccuucguguucggcaggaaaagccgggucguggacuugaaccugcucaccgaggagguacgccuguacuccuguacccccaggaauuuuagcgugaguauccgggaggaacugaagcgcacggauacuauuuucuggccagguugcuugcucgucaagaggugugggggcaacugcgcguguugccugcacaauuguaacgaaugccaaugcgugcccuccaaggugaccaaaaaguaucaugagguccugcagcuccggccaaaaacuggcgugcgcgggcugcacaagagcuugaccgacguagcccuggaacaccaugaggagugugacugcguguguagggguaguaccggcgggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4535 - RNA, 1442 nt, Artificial Sequence
  mRNA product Design3 comprising derived and/or modified sequence from Homo sapiens__NP_149126.1__HsPDGFD (opt7)
gggagagucccgcagucggcguccagcggcucugcuuguucgugugugugucguugcaggccuuauucaagcuuaccaugcacaggcugaucuucguguacacccucauuugcgccaacuuuuguagcugccgggacacuuccgcaacgccccagagugccagcaucaaggcgcugcgcaaugccaacuugaggcgggaugaccuguaucgcagggaugagaccauucaagucaaaggcaauggguacgugcaguccccacgguucccgaacaguuauccccgcaaucuccuguugacuuggaggcugcauagccaggaaaacacccggauccagcucguauuugacaaucaauucggucuggaggaagcagagaacgauauuugucgcuacgacuuuguggaagucgaggauaucuccgagaccagcacuaucauuaggggccgguggugcgggcacaaggaagugccaccccgcaucaaauccaggaccaaucagauuaagaucacguucaaaagugacgauuauuuuguggccaagccaggcuucaagauuuacuauagccugcucgaggacuuucagcccgcagccgcguccgaaacuaacugggagagcgucaccaguuccaucagcgguguguccuacaauaguccaagcguaacugauccgacccugauugccgacgcauuggauaaaaagaucgccgaguucgacaccguggaagaccugcucaaauacuuuaaccccgaguccuggcaggaagaucuggagaauauguaucuggacacgccacgguaccgcgggaggagcuaucaugaucggaagaguaaagucgacuuggaucgccucaacgacgaugccaagagguacuccuguacuccccggaauuauagcgugaacaucagggaggaacugaaacuggcaaacguggucuucuucccacgcugccuccuggugcaacgguguggcggcaauugcgggugugguaccguaaacuggaggaguugcacuugcaauuccggcaagaccgugaagaaauaccacgaggucuugcaguuugaacccgggcauauuaagcgccggggcagggccaaaaccauggcgcugguggacauccagcucgaucaccacgagcgcugugacugcauuuguagcagccggccgcccaggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4536 - RNA, 1025 nt, Artificial Sequence
  mRNA product Design3 comprising derived and/or modified sequence from Homo sapiens__NP_003946.3__HsSOCS3 (opt7)
gggagagucccgcagucggcguccagcggcucugcuuguucgugugugugucguugcaggccuuauucaagcuuaccauggugacccacagcaaguuccccgccgcaggcauguccaggccacuggacaccagucuccggcugaaaacuuuuagcuccaagagugaguaccaguuggucgugaacgccguacgcaaacugcaagaaagcggguucuauugguccgcggugacggguggcgaggccaaucuccuguugagcgcagaaccggccgggacuuuucugaucagggauuccagugaccagcggcauuucuuuacccucagcgucaagacccaguccggcacuaaaaaccugcgcauucagugcgagggugggagcuucagucugcaauccgaucccaggagcacccagccagugccccgguuugacugugugcucaagcugguccaccauuacaugccacccccaggcgcaccguccuuccccaguccacccacggaaccaagcuccgaggugcccgagcagccgagcgcccagcccuugccaggcagucccccacgcagggcguauuacaucuauuccgggggugaaaagauuccccugguacucagccggccacugaguuccaauguggccacucugcaacacuugugccgcaaaaccgucaacggccaucucgauagcuacgagaaggugacucagcugccggggcccaucagggaauuucuggaccaguaugaugcaccacucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4537 - RNA, 830 nt, Artificial Sequence
  mRNA product Design3 comprising derived and/or modified sequence from Homo sapiens__NP_003227.1__HsTGFA (opt7)
gggagagucccgcagucggcguccagcggcucugcuuguucgugugugugucguugcaggccuuauucaagcuuaccauggugcccagcgccggccagcuggcacucuucgcccuggggaucgucuuggcggccugccaagcacuggagaacuccaccaguccacucagcgccgacccgcccguggcagccgcgguagugucccacuuuaaugauuguccagacagucauacucaguucugcuuucacgguaccuguagguuccugguccaggaagauaagcccgccugcgugugucauagcggcuacgugggggcacggugcgagcacgccgacuugcuggccgucguggcagccucccagaaaaagcaagcgauuacggcccucguaguggucagcaucguggcacuggccgugcugauuaucacuuguguccucauucauugcugucaggugcgcaaacacugcgaauggugcagggcacugaucugucggcacgagaagccauccgccuugcugaaaggccgcaccgccugcugucauagugaaaccguagugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4538 - RNA, 1520 nt, Artificial Sequence
  mRNA product Design3 comprising derived and/or modified sequence from Homo sapiens__NP_000651.3__HsTGFB1 (opt7)
gggagagucccgcagucggcguccagcggcucugcuuguucgugugugugucguugcaggccuuauucaagcuuaccaugcccccaagcggccugaggcuccugccguugcugcucccccuguuguggcugcucgugcugaccccagggcggcccgccgcaggucuguccacuugcaagaccaucgacauggagcucgucaaacgcaagaggauugaagccauccggggccagauucugaguaaauugcgccuggcgagcccacccucccaaggggaggugccaccgggcccccucccagaagccguacuggcacuguacaacaguacgagggaucggguggccggugagagcgcagaacccgagccagagcccgaagccgacuauuacgcgaaggaggucacucgcguguugaugguggaaacccacaaugagaucuaugauaaauucaagcaguccacccauagcauuuacauguuuuucaacacuuccgagcucagggaagccgucccggagcccgugcugcugagucgggcagaacuccgccuguugaggcugaagcucaaaguagagcagcacguggaacuguaucagaaguacagcaauaacuccuggcgguaucugagcaaucgcuugcucgccccaagugacucccccgaguggcugagcuuugaugucaccgggguggugaggcaauggcugucccggggcggcgagaucgaaggguuccgccucagugcccauuguagcugcgacuccagggauaacacgcugcaggucgacaucaaugguuuuacuaccggccggcgcggggauuuggcaacuauucacggcaugaacaggccauuccugcuccugauggccacgccccuggagcgggcgcagcauuugcagagcaguaggcaccgccgggcccucgacaccaauuacuguuuuuccagcaccgagaaaaacugcugugugaggcaacuguacaucgauuuccgcaaggaccuggguuggaaauggauucacgaaccaaagggguaucaugcaaauuuuugccucggcccgugucccuacaucuggagucuggauacucaguauuccaaaguauuggcccuguacaaccagcacaauccaggcgcaagcgccgcccccugcugugugccacaggcgcucgaaccccugccgauugucuauuacguggggcggaagccaaagguggagcaacugagcaacaugaucgucagguccugcaaaugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4539 - RNA, 1592 nt, Artificial Sequence
  mRNA product Design3 comprising derived and/or modified sequence from Homo sapiens__NP_003229.1__HsTGFB2 (opt7)
gggagagucccgcagucggcguccagcggcucugcuuguucgugugugugucguugcaggccuuauucaagcuuaccaugcacuacugcgugcugagcgccuuccucauccugcauuuggucaccguggcacugucccucaguacuuguagcacccuggacauggaucaguuuaugaggaagcggauugaggccauccgcggccaaauuuuguccaaacugaagcucacgagucccccagaagacuauccggagcccgaagagguaccacccgaagugaucagcauuuacaacuccacuagggaucugcugcaggagaaagcgagccggcgcgccgcagccugcgagagggaacgguccgacgaggaauauuacgcaaaggaggucuauaaaaucgauaugccacccuucuuuccaagugagaaugccaucccgcccaccuucuaccgcccauauuuuaggauugugcgguucgacgugagcgcgauggaaaagaacgccuccaaucucgucaaggcagaguuucgcguguucaggcugcagaaccccaaagcccggguaccagaacagcgcaucgaguuguaccaaauucucaagagcaaagaucugaccagucccacucagagguacaucgacuccaagguggucaaaacccgggccgaaggggaguggcugagcuuugaugugacggacgcagugcacgaguggcugcaucacaaggaucgcaauuuggguuucaaaauuucccuccauuguccgugcuguacuuuuguccccaguaacaauuauaucauuccaaacaagagcgaggaacuggaagccagguucgcgggcaucgacgggaccuccacuuacaccagcggcgaucagaagaccaucaaaaguacgcggaagaaaaauuccgguaagacuccccaucugcuccugauguugcugccaagcuaucgccucgagagucagcaaaccaacaggcggaaaaagagggcccuggacgcagccuacugcuuccgcaaugugcaggacaacuguugccugcggcccuuguauauugauuuuaagagggaccucggguggaaauggauccacgaaccaaagggcuacaaugcaaacuucugugccggcgccugcccguaucugugguccagcgauacucagcacagccgcguacugucccucuacaauaccauuaaccccgaggcgagugcaagcccaugcugugugucccaggaccuggagcccuugaccauccuguacuauauugggaaaacuccaaagaucgaacaacucagcaacaugaucgucaaaaguugcaaguguuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4540 - RNA, 1586 nt, Artificial Sequence
  mRNA product Design3 comprising derived and/or modified sequence from Homo sapiens__NP_003230.1__HsTGFB3 (opt7)
gggagagucccgcagucggcguccagcggcucugcuuguucgugugugugucguugcaggccuuauucaagcuuaccaugaagaugcaucugcagagggcccucgugguccuggcauugcugaacuucgccaccgugagccucucccugaguacuugcaccacguuggacuuuggccacaucaaaaagaaacggguagaggcgauucgcgggcaaauccugagcaagcucaggcugacuuccccacccgaaccgaccgugaugacccacguccccuaccaggugcuggcccucuauaauaguacucgggagcuguuggaagagaugcauggugaacgcgaggagggcuguacccaggaaaacacggagagcgaauacuaugcaaaagagauucacaaguucgauaugauccaggggcuggccgagcauaaugaacucgcagugugcccaaagggcauuacuuccaaagucuuuagguucaacgugagcuccguagagaagaaucggaccaaccuguuucgcgccgaguucagggugcugcggguccccaauccaaguagcaaacgcaacgaacaaaggaucgaauuguuucagauccuccggcccgacgagcacauugcgaagcagcgcuacaucggugggaaaaaucugccaacuaggggcaccgccgaguggcuguccuucgaugugaccgacacggugcgggaauggcuccugcgcagggagagcaacuugggccuggaaauuaguauccacuguccgugccauacuuuucagcccaauggggauauucucgagaacauccacgaagucauggagauuaaguucaaagguguggacaaugaggaugaccauggccgcggggaucugggccggcugaagaagcaaaaagaccaccacaacccacauuugauccucaugaugauucccccacacaggcuggauaaucccggucaagggggccagcggaagaaaagggcacuggacaccaacuauuguuuucgcaaccucgaagagaauugcuguguacggccgcuguacaucgauuucaggcaggacuugggcuggaagugggugcaugaacccaaaggguauuacgccaacuucugcuccgguccaugucccuaccugcgcagcgccgacacuacccacuccaccguccucggccuguauaauacucugaacccagaggcaagugccagccccugcugcgugccacaggauuuggaaccgcucacgauccuguacuauguggggcggacccccaaggucgagcagcuguccaauauggugguaaagagcuguaaaugcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4541 - RNA, 1733 nt, Artificial Sequence
  mRNA product Design3 comprising derived and/or modified sequence from Homo sapiens__NP_001057.1__HsTNFRSF1B (opt7)
gggagagucccgcagucggcguccagcggcucugcuuguucgugugugugucguugcaggccuuauucaagcuuaccauggcccccguggcagucugggccgcgcuggccgugggccucgagcugugggcagccgcacacgccuugccagcgcagguagccuucaccccguacgcacccgaaccagggagcacuugcaggcugcgggaguauuacgaccaaaccgcccagauguguugcuccaaguguagucccggucagcaugccaaaguguuuugcacgaagacuagcgauaccgucugugacuccugcgaagauaguaccuauacucagcucuggaacugggugccagagugucugagcugcggcucccgcuguagcuccgaccaaguggaaacccaggcaugcacgagggagcagaaucggaucugcacuugucgccccgggugguacugcgccuugaguaaacaggagggcuguaggcugugcgcgccacuccggaagugucgcccggguuucggggucgccaggcccggcaccgaaacuagcgaugugguaugcaaaccaugugcacccggcaccuuuuccaacaccacgagcaguacugacauuugccggccacaccaaaucuguaauguggucgccauucccgggaacgcauccauggaugccgugugcaccagcacuuccccgacccgcaguauggcccccggugcggugcaucugccacagcccgucagcaccaggucccagcacacucagccaacgcccgagccaagcaccgcaccgaguacuuccuuccugcuccccaugggcccaagucccccagccgaagggagcaccggcgacuuugcccugcccguggguuugaucguaggggugaccgcacugggccuccugauuaucggcgucgugaauugcgugaucaugacucaagucaagaagaaaccgcuguguuugcagcgggaggccaaggugccacaucuccccgcggauaaagcccgcgggacgcagggucccgagcaacagcaucugcugauuaccgcaccauccagcagcuccaguagccucgaauccagcgccagugcacuggacaggcgggcccccacucgcaaccagccacaggccccgggcguagaggcauccggggccggcgaagcgagggccagcaccgguuccagugauagcucccccggcgggcacggcacccaagugaaugucacuugcaucgugaacgucuguagcaguuccgaccacagcucccagugcaguagccaggcauccagcacgaugggggauaccgacaguuccccaagcgagucccccaaggacgaacaggugccauucagcaaagaggagugugccuuucggagucaauuggaaacucccgagacccugcucgguagcacugaagagaagccgcugccacugggcgugcccgaugccgggaugaaaccauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4542 - RNA, 860 nt, Artificial Sequence
  mRNA product Design3 comprising derived and/or modified sequence from Homo sapiens__NP_002623.2__HsPGF (opt7)
gggagagucccgcagucggcguccagcggcucugcuuguucgugugugugucguugcaggccuuauucaagcuuaccaugcccgugaugaggcuguucccaugcuuucuccagcuguuggccggccuggcacucccggccgugcccccacaacagugggcgcugagcgccgggaacgguuccagugaggucgaaguagugcccuuccaggaggucuggggccggagcuacugucgcgcauuggaaaggcugguggacguggucuccgaguauccaagugaaguggagcacauguuuagccccuccugcguaagccuccugcgguguaccgggugcuguggcgaugagaaucugcauugcgugccagucgaaacugccaacgugaccaugcagcuccugaagauccgcuccggugacaggccgaguuacguggaguugacguucagccaacacguccggugugaaugccgcccccugagggagaaaaugaagccagagcggcgcaggcccaaagggcggggcaagcgcaggcgggaaaaacagcgcccaacugauugucaucucugcggcgacgcagugcccaggcggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4543 - RNA, 1586 nt, Artificial Sequence
  mRNA product Design3 comprising derived and/or modified sequence from Homo sapiens__NP_001020537.2__HsVEGFA (opt7)
gggagagucccgcagucggcguccagcggcucugcuuguucgugugugugucguugcaggccuuauucaagcuuaccaugaccgacaggcagacugauaccgcccccagcccauccuaccaucugcucccgggccggcgcaggacgguggacgcagccgcgagucgggggcaaggucccgagccagcccccggcgggggcgucgaaggugugggggcacgcggcguagcccugaaguuguucgugcagcugcucggcugcagcagguuugggggugcagucgugcgggccggcgaggcggaaccauccggggccgcacgcagugccagcuccggcagggaggaaccccagccagaggagggugaagaggaagaggagaaagaagaggaacgggggccgcaguggcgccugggcgccaggaagcccggcagcuggacuggggaggcagccgugugugcggauuccgccccagcagcccgggcaccccaagccuuggcccgcgcgagugguaggggcgggcgggucgcacgcaggggcgccgaagagagcgguccaccccacuccccgagccggcgcggcagugccuccagggcagggcccggccgggccagcgagaccaugaacuuccugcucuccugggugcacuggagucuggcgcugcuccuguauuugcaucacgccaaauggagccaggcagccccaauggcagaaggggguggccagaaucaucacgagguagugaaguuuauggacgucuaccagagguccuauugccaccccaucgaaacccugguggauauuuuccaagaguacccagacgaaaucgaguauauuuuuaaacccagcugugugccacucaugcgcugcgggggcuguugcaacgaugagggucuggaaugugucccgacugaggaaaguaauaucaccaugcagauuaugcggaucaagccccaucagggccagcacaucggggagauguccuuccugcaacauaacaagugcgaauguaggcccaaaaaggaccgcgcccggcaggagaaaaagagcgugaggggcaaagggaagggccagaaacgcaagcggaagaaaaguagguacaaguccuggagcguauaugugggugcccggugcugcuugaugccauggagccucccagggccccacccguguggcccaugcuccgagcgcaggaaacaccuguuuguccaagauccccagacguguaagugcaguuguaaaaauacugacagccggugcaaggcacgccagcuggaacucaacgagaggaccugucggugcgauaagcccaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4544 - RNA, 1046 nt, Artificial Sequence
  mRNA product Design3 comprising derived and/or modified sequence from Homo sapiens__NP_001165094.1__HsVEGFA (opt7)
gggagagucccgcagucggcguccagcggcucugcuuguucgugugugugucguugcaggccuuauucaagcuuaccaugaacuuccugcucagcugggugcacuggucccuggccuugcugcucuaccugcaucacgcaaaguggagucaggccgcgcccauggccgagggcgggggucaaaaucaucacgaagucgugaaauuuauggacguauaucagaggagcuacugccauccaaucgagaccuugguggauauuuuccaggaauauccggacgagaucgaauacauuuuuaagcccuccugugucccacugaugcggugcggcggguguugcaacgaugagggccucgagugugugcccacugaagagaguaauaucaccaugcagauuaugcgcaucaaaccacaccaaggucagcacaucggggaaaugagcuuccugcagcauaacaagugcgaguguaggcccaaaaaggaccgggcacgccaggagaagaaauccgugaggggcaagggcaaagggcaaaagcggaaacgcaagaaaagcagguauaaguccuggagugucuacgugggugcccggugcugucugaugccauggagccucccgggcccccacccaugcgggcccugcuccgaacgcaggaagcaucuguuuguacaggauccacagacguguaaaugcagcuguaagaauacugacagucggugcaaagcacgccaguuggagcugaacgaaaggaccugucggugcgauaagcccaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4545 - RNA, 971 nt, Artificial Sequence
  mRNA product Design3 comprising derived and/or modified sequence from Homo sapiens__NP_003368.1__HsVEGFB (opt7)
gggagagucccgcagucggcguccagcggcucugcuuguucgugugugugucguugcaggccuuauucaagcuuaccaugagcccccugcucaggcggcuguugcuggccgcacuccugcaguuggccccagcgcaagccccggugucccagcccgacgcaccaggccaccagcgcaaggucgugaguuggaucgauguauacaccagggccacuugccagccccgggagguggucgugccacugaccguggaacucauggggacggucgcaaaacaacuggugcccagcuguguaacugugcagcgcugcgguggcuguugcccagacgaugggcuggagugugucccgaccggccagcaucaggugaggaugcaaauucucaugauccgguaucccuccagucagcugggugaaaugagcuuggaggaacacucccagugcgagugucgcccaaagaaaaaggacagcgccgugaaacccgauagggcggccaccccacaucaccggccccagccgcgcuccguccccgggugggacagugcaccaggcgcccccagcccagccgauauuacucaucccaccccagcaccgggccccuccgcccacgcggccccaagcacgaccagugcacugacucccgggccagccgcagccgccgcggacgcagccgccuccagcguggcaaaggguggcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4546 - RNA, 1607 nt, Artificial Sequence
  mRNA product Design3 comprising derived and/or modified sequence from Homo sapiens__NP_005420.1__HsVEGFC (opt7)
gggagagucccgcagucggcguccagcggcucugcuuguucgugugugugucguugcaggccuuauucaagcuuaccaugcaucugcucggcuucuuuagcguggccugcucccuguuggcagccgcgcugcuccccgggccaagggaggccccggcagccgcagccgcguucgaaaguggucuggacuugagcgaugccgagcccgacgcaggcgaagccaccgccuacgcauccaaggaucuggaggaacagcuccggagugucagcuccguggacgagcugaugacuguacuguauccagaguacuggaaaauguauaagugucaacuccgcaaagggggcuggcagcacaacagggaacaggccaaucugaacagccggaccgaggaaacgaucaaguuugcggccgcacacuacaauacugagauuuugaaauccaucgauaacgaguggcgcaagacccagugcaugcccagggaaguguguauugacgucgguaaggaguucgggguggccaccaauacuuucuucaaaccacccugcgugagugucuaucgguguggcggcugcuguaacagcgaagggcugcaaugcaugaauaccuccacgagcuaccucaguaagacucuguuugagaucaccgugccacugucccaggguccgaaacccguaacuauuagcuucgcaaaccauaccuccugucgcugcaugaguaaguuggauguguauaggcagguccacagcaucauccggcgcucccucccagccacccugccccagugccaagccgcgaauaaaacguguccaacuaacuacauguggaauaaccauauuuguaggugccuggcacaggaagacuuuauguucagcagugaugccggcgacgauuccaccgacggguuucacgauaucugcggccccaauaaggagcucgacgaggaaacuugucagugcgugugucgggccggucugcgcccggcaagcugcgggccccacaaagaguuggacaggaacaguugucagugcgugugcaagaauaagcuguucccaucccaauguggcgccaaccgggaauuugaugagaauaccugccagugugucugcaaacgcaccugucccaggaaccagccacucaaccccggcaagugcgcgugugaaugcacugagagcccacaaaaaugucugcugaaggggaaaaaguuucaucaccagacgugcagcuguuaccggcgcccgugcaccaauaggcagaaggccugcgagcccgguuucuccuauagugaagaggugugucggugcguaccaagcuacuggaaaaggccccagauguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4547 - RNA, 1412 nt, Artificial Sequence
  mRNA product Design3 comprising derived and/or modified sequence from Homo sapiens__NP_004460.1__HsVEGFD (opt7)
gggagagucccgcagucggcguccagcggcucugcuuguucgugugugugucguugcaggccuuauucaagcuuaccauguacagggaguggguggucgugaacguauucaugaugcuguaugugcagcucguccaaggcagcuccaaugaacacgggcccgugaagcggaguagccaguccacccuggagcgcagugaacagcagaucagggccgcaagcuccuuggaggaacugcuccggauuacucauagcgaggacuggaaacuguggcgcugcagguugcggcugaaguccuuuaccaguauggauagccgcuccgccagccacaggaguacgcgguucgcggccacuuuuuacgacaucgagacccucaaagugauugaugaagaguggcaacgcacccaguguuccccaagggaaacuugcgucgagguggcaagcgagcuggguaaguccaccaacacguucuuuaaaccgcccuguguaaauguguuccggugcggcggguguugcaacgaagagagucugaucuguaugaauacuagcaccuccuauauuagcaagcagcucuuugaaaucagugucccacugacuuccgugcccgaguuggugccagucaagguggccaaccauaccggcugcaaaugucugcccaccgcaccacgccacccguacagcaucauuaggcggaguauccagauucccgaagaggaccgcugcucccauagcaagaaacucugcccaaucgauaugcugugggacagcaauaaguguaaaugcguacugcaagaggaaaaccccuuggccgguacggaggaucacucccaccuccaggaaccagcgcugugugggccccauaugauguucgacgaggauaggugcgaaugugugugcaagacuccgugucccaaagaccugauucagcacccaaagaauugcaguuguuuugagugcaaggagagccucgaaaccugcugucagaaacauaagcuguuccaccccgauacuugcuccugugaggaccggugcccauuucacacccgccccugugccagcggcaaaaccgcaugcgccaagcauuguagguucccaaaagaaaagcgggccgcacaaggcccgcacaguaggaagaaccccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4548 - RNA, 977 nt, Artificial Sequence
  mRNA product Design3 comprising derived and/or modified sequence from Homo sapiens__NP_061986.1__HsFGF21 (opt8)
gggagagucccgcagucggcguccagcggcucugcuuguucgugugugugucguugcaggccuuauucaagcuuaccauggacuccgacgaaaccggcuucgaacacuccggccucugggucuccguccucgccggccuacuacuaggcgccugccaagcccaccccauccccgacucauccccacuucuacaauucggcggacaagucagacaacgauaccucuacaccgacgacgcccaacaaacagaagcccaucucgaaauaagagaagacggcaccgucggcggcgccgccgaccaaucccccgaaucccuacuccaacucaaagcacucaaacccggcgucauccaaauccucggcgucaaaaccucccgcuuccuaugccaacgccccgacggcgccuuauacggcucccuacacuucgaccccgaagccugcucuuuucgcgaacuccuacucgaagacggcuacaacguauaccaauccgaagcccacggccuaccccuacaccuccccggcaacaaaucaccccaccgcgacccagccccacguggccccgcacgcuuccucccacuaccaggccucccacccgcccuccccgaaccacccggcauccucgcaccccaaccacccgacguaggcuccucagacccccucuccauggucggccccucccaaggccgcucacccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4549 - RNA, 1757 nt, Artificial Sequence
  mRNA product Design3 comprising derived and/or modified sequence from Homo sapiens__NP_002412.1__HsMMP1 (opt8)
gggagagucccgcagucggcguccagcggcucugcuuguucgugugugugucguugcaggccuuauucaagcuuaccaugcacuccuucccaccccuccuccuacuucucuucuggggcguaguaucccacuccuuccccgccacacuagaaacccaagaacaagacguagaccugguccaaaaauaccuagaaaaauacuacaaccucaagaacgauggacgacaagucgaaaaacgccgcaacuccggcccggucguagaaaagcuaaaacaaaugcaagaguucuucggccuaaaagucacuggcaaaccagacgccgaaacccucaaagucaugaaacaaccacgaugcggcgucccagacgucgcacaauucguccucacagaaggcaacccccgaugggaacaaacccaccucaccuaccgaauugaaaacuacacaccugaccugcccagagccgacguagaccacgccauagaaaaagccuuucaacucuggucaaacgucacaccccucaccuuuaccaaagucucggaaggccaagccgacauaaugauuagcuucguucgaggcgaccacagagacaacucccccuucgacggacccggcggcaaccucgcccacgccuuccaacccggcccggguauaggcggagaugcacauuucgacgaagacgaacgcuggacaaacaacuucagagaauacaaccuccaccguguagcagcccacgaacuaggccacucacucggacucucacacagcaccgacaucggagcccuaauguacccauccuacacuuucuccggagacguucaacucgcccaagacgacaucgacggcauccaagcaaucuacggccgcucccaaaacccaguacaacccaucggaccacagacucccaaagccugcgacuccaaacucaccuuugacgcaaucaccaccauccgaggcgaagucauguucuucaaagaccgcuucuacaugcgcacgaaccccuucuacccagaagucgaacucaacuucauaucagucuucuggccccaacuaccaaacggccuugaagcagcauacgaauuugccgacagagacgaaguccgcuucuucaaaggaaacaaauacugggccguccaaggccaaaacguccuucacggcuaccccaaggacauauacuccuccuucggcuucccccgaacagucaaacacaucgacgcggcacuguccgaagaaaauaccggcaagacauacuucuucgucgccaacaaauacuggcgguacgacgaauacaaacgauccauggaccccggcuaccccaaaaugauagcacacgacuucccgggaaucggccacaaagucgaugcaguauucaugaaagacggauucuucuacuucuuccacggcacacgccaauacaaauucgaccccaaaacaaaacgcauccucacccuccagaaagccaacagcugguucaauugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4550 - RNA, 1517 nt, Artificial Sequence
  mRNA product Design3 comprising derived and/or modified sequence from Homo sapiens__NP_002412.1__HsMMP1(1-19,100-469) (opt8)
gggagagucccgcagucggcguccagcggcucugcuuguucgugugugugucguugcaggccuuauucaagcuuaccaugcacuccuucccuccccuacuacuccuacuauucuggggagucguaucacacuccuucguccucaccgaaggcaacccucgaugggaacaaacccaccucacuuaccgaaucgagaacuacacccccgaccucccacgagccgacgucgaccacgccaucgaaaaagccuuucaacuaugguccaacgucacaccccucaccuucacuaaaguaagcgaaggccaagccgacaucaugaucagcuucguccgcggagaccaccgagacaauucccccuucgacggcccaggaggcaaccuagcccacgccuuucaaccaggacccggcauaggaggcgacgcccacuucgacgaagacgaacgauggacaaacaacuuccgcgaauacaaccuccacagaguagccgcccacgaauuaggccacucccuaggacucucacacucaaccgacauaggugcccucauguaccccuccuacaccuucagcggcgacguccaacuagcccaagacgacaucgacggcauacaggccaucuacggccgaucucaaaauccaguccaacccauaggaccacagacaccaaaagccugugacuccaaacucaccuucgacgccaucaccaccauacgcggagaagucauguucuuuaaagacagauucuacaugcguaccaaccccuucuacccagaaguagaacuaaacuucauaucugucuucuggccacaacuccccaacggccuagaagcagcauacgaauuugcugacagagacgaaguacgauucuucaaaggcaacaaauacugggccguccaaggccaaaacguacuacacggcuacccaaaagacaucuacuccuccuucggcuucccccgcacagucaaacacaucgaugccgcacucagcgaagaaaacaccggaaaaaccuacuucuucgucgccaacaaauacuggcgauacgaugaauacaaacgauccauggaccccggauaccccaaaaugaucgcccacgacuuccccggaauaggccacaaagucgacgcaguuuucaugaaagacggcuucuucuacuucuuccacggaaccagacaauacaaauucgaccccaaaaccaaacgcauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4551 - RNA, 3704 nt, Artificial Sequence
  mRNA product Design3 comprising derived and/or modified sequence from Clostridium histolyticum__BAA77453.1__ColG (opt8)
gggagagucccgcagucggcguccagcggcucugcuuguucgugugugugucguugcaggccuuauucaagcuuaccaugaagaaaaacauccucaaaauacucauggacucguauucuaaggaauccaaaauccaaaccgucagacgcgucacuagcgucucccuccucgcgguguaccuaacuaugaauacguccagccuaguccucgcaaagccuaucgagaacaccaacgacaccagcauuaaaaacguugagaagcuacgcaacgcgccaaacgaggaaaacucaaagaaagucgaagacagcaaaaaugacaaaguagagcacguuaaaaacauagaagaagccaagguggaacaaguagcaccggaagucaaaagcaaaaguacccuacgcagcgccagcauugccaacaccaacagcgaaaaguacgacuucgaguaucuuaacgggcucagcuacacagaacuaacaaaccugaucaaaaacauaaaauggaaccaaauaaacgguuuguucaacuacagcacagggucacaaaaauucuucggcgauaaaaaccgcguccaggccaucauaaacgcccuacaagaaagcggccgcacauacaccgcgaacgacaugaagggaauagaaaccuucacggagguauuaagggcgggguucuaccuaggcuacuacaaugacggacucucauaccuaaacgaccgcaacuuccaagacaagugcauccccgccaugauagccauacagaaaaacccaaauuuuaaacucggcacggccguccaagacgaaguuauaacauccuuagggaaacucaucggaaacgccucggccaacgccgaaguggugaacaacugcguccccguacuuaagcaauuccgcgaaaaccuaaaccaauacgcacccgacuacguuaaggggaccgcggucaacgaauugauaaaaggaaucgaguucgacuuuagcggagcagcauaugaaaaggacgugaagacaaugcccugguacggcaagauugauccguucauuaacgaacucaaggcccucggacuauacggaaacauaaccucagcaaccgagugggcuucagauguaggcaucuacuaccugagcaaguucggccuauacagcaccaaccgcaacgacauugugcaaaguuuagaaaaagcagucgacauguacaaguacggcaagauugcauuuguagcgauggaacgaauaacgugggacuacgacggcaucggcuccaacggaaagaaagucgaccacgacaaguuccuggaugacgccgagaagcacuaccuccccaagacauacaccuucgacaacggcaccuucaucauccgagccggcgacaaaguaucggaagaaaagaucaagagacuauacugggccuccagagaagucaaaucccaauuccaccgagucgucggaaacgacaaggcccuagaaguaggaaacgccgacgacguauuaacuaugaaaauuuuuaacagcccagaagaauacaaauucaacaccaauauuaacggcguaucaacagacaacggaggacuguacauagaaccccgagggacauucuacacauacgaacggaccccacaacaauccaucuuuagccuggaagaacucuucagacacgaauacacccacuaccuacaggccagauaccuagucgacgguuuauggggacaaggccccuucuacgagaaaaaccgacucacaugguuugacgagggcacagccgaguucuucgcaggaucaacaagaaccagcggcgugcucccgcgaaagucgauccuuggcuauuuagcgaaagacaaaguagaccacagauacagccuaaagaaaacacugaacucaggcuacgacgauagcgacuggauguucuacaacuauggcuucgcaguagcgcacuaccuuuacgaaaaagacaugccgacguucaucaagaugaacaaagcaauacuaaacaccgacguuaaaucguacgacgaaauaaucaaaaagcuguccgacgaugccaacaaaaacacagaauaccaaaaccauauccaggaacucgcggacaaguaccagggggcaggaaucccccuagucucggacgacuaccuaaaagaccacggcuacaagaaagcaagcgaaguauacagugagaucagcaaagccgccucccuaacgaacacaucagugacugcugagaaaagccaguacuucaacaccuucacacuccgaggaacuuacacgggagaaacaucaaaaggcgaguucaaagacugggacgaaaugagcaagaaauuagacggcacccuagaaucacuagcgaaaaacucuuggagcggauacaagacccuuaccgcauacuucacgaacuacagggucaccagugacaacaaagugcaguacgacgucguguuccacggaguucuaacagacaacgccgacaucuccaauaacaaagcaccaaucgccaaggugacggggccaagcacaggagccgucggacgaaacauagaguucucaggcaaagacagcaaggacgaagacgggaagauaguaaguuacgacugggacuucggugacggagcaacaucccgcgguaagaacagugugcacgcauauaagaaggccggaacauacaacguaacccuaaagguaacggacgacaaaggagcgacagcgaccgaaucguuuacuaucgaaauaaagaacgaagacacgaccacuccaauaacaaaagaaauggaaccaaacgaugacaucaaagaagccaacggcccuauagucgaagguguaaccguaaaaggcgaccucaacggcuccgacgacgcagacacguucuacuucgacgugaaagaagacggggacguaacaaucgaacuccccuacuccggcuccucaaacuucaccuggcuaguauacaaggaaggggacgaucaaaaccacaucgcaagcggaaucgauaaaaacaauaguaaaguagggaccuucaaaucgacaaagggaaggcacuacgucuucauuuacaagcacgacagcgccagcaacauaaguuacuccuuaaacaucaaaggacuaggcaacgaaaaacuuaaggaaaaagagaacaacgacucaagcgacaaagcgacuguaaucccaaacuucaauacgacaaugcaagguucccuccucggagacgacucacgggacuacuacagcuucgaagucaaggaagaaggcgaagugaacaucgaacuggacaaaaaggacgaguucggcguaaccuggacccugcaccccgaaagcaacaucaacgacaggaucaccuacggccaaguagacggcaacaaagucagcaacaaagucaaacuccgccccggcaaguacuaccuacuggucuacaaguacagcggcucaggaaacuacgaacuccgcgucaacaaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4552 - RNA, 3428 nt, Artificial Sequence
  mRNA product Design3 comprising derived and/or modified sequence from Clostridium histolyticum__BAA77453.1__HsALB(1-18)_ColG(111-1118) (opt8)
gggagagucccgcagucggcguccagcggcucugcuuguucgugugugugucguugcaggccuuauucaagcuuaccaugaaaugggucaccuucauaagccuccucuuucuguucagcagcgcauacucaauagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4553 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt8)
gggagagucccgcagucggcguccagcggcucugcuuguucgugugugugucguugcaggccuuauucaagcuuaccaugaaauggguaaccuucauaucccuccuguuccuauucucaucagcauacagcaugaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4554 - RNA, 3452 nt, Artificial Sequence
  mRNA product Design3 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaacuuccucaaaauaauccuaaaccgaggcaaaaccaugaagcgcaaaugccucagcaagagacucaugcucgcaaucaccauggcuacaaucuucacaguuaacucaacucuccccaucuacgccgcgguagacaaaaacaacgcaaccgccgccguccaaaaugaaucuaaacgauacacagucagcuaccuaaaaacccuuaacuacuacgaccucguagaccugcucgugaaaaccgaaaucgagaaccucccggaccuguuccaauauuccagcgaugccaaagaguucuacgggaacaaaacacgaaugucguucaucauggacgaaaucggacgccgagcgccccaauacaccgagauugaucauaagggaaucccgacgcucgucgaagucguccgagccggguucuaucucggcuuccacaacaaggaacucaacgagauaaacaaacgcucuuucaaggaacgcgucauaccguccauacuugccauacagaaaaaccccaauuucaagcucggaacagaaguacaagacaaaaucguauccgccaccggccugcuagccggaaacgaaaccgcaccaccagaagucgucaacaacuucacucccauccuucaagacugcaucaagaacaucgacagauaugcauuggacgaccuaaaaucaaaagcacuguucaacguucuagccgcgcccacauaugauauaaccgaauaccucagagcaacaaaggagaaacccgaaaacacucccugguacggcaaaaucgacggcuucaucaacgaacuaaagaaacucgcauuauacggcaaaaucaacgacaacaacaguuggaucauagacaacggcauauaccacaucgcgccacuaggaaaacuacacucuaacaacaaaaucggaaucgaaacacuaaccgaagucaugaagguauaccccuaccugagcaugcaacaccuucaaucugcagaucaaaucaaacgacacuacgacagcaaagacgccgagggaaacaagaucccauuagacaaauucaagaaagaaggaaaagagaaauacugcccaaagaccuacacguuugaugauggcaaaguaaucauaaaggccggcgcacgcgucgaggaagaaaaagucaaacgccuguacugggcgucaaaagaagucaacucccaauucuuccgagucuauggcaucgacaaaccccucgaggaaggcaaccccgacgacauacugacaauggucauuuacaacucgccugaggaauacaaacugaacucagugcuauacggcuacgacaccaacaacggcggcauguacaucgaacccgaaggcacuuucuucacuuacgagagagaggcccaagaauccacguacacacuagaagaacuuuuccgacacgaguacacccacuaccuccaaggccguuacgcagucccgggacaauggggacgaacgaaacucuacgacaacgacaggcugaccugguacgaagagggcggggcggaacuauucgcagggagcaccaggacaucggggauacuucccaggaaauccaucgucuccaacauccacaacacaacacgaaauaaucgguauaaacugagcgauaccguccacucaaaauacggcgcgucauucgaguucuacaacuacgccuguauguucauggacuacauguacaacaaagauaugggaauccucaacaaauuaaacgaccucgcuaagaacaacgacguagacggcuacgacaacuacauaagagaccuauccucaaacuacgcucugaacgacaaauaccaagaccacaugcaggaacgaaucgacaacuacgaaaaccucaccgucccguucgucgccgacgacuaccucgugagacacgccuacaaaaaccccaacgaaaucuacagcgagaucagcgaagucgccaaacucaaggacgcaaaauccgaggucaaaaagucucaauacuucagcaccuucacucuacgcggcucauacacgggcggcgccuccaaaggcaaauuagaagaccaaaaagccaugaacaaguuuaucgacgacagccucaagaaacuugacaccuacucguggaguggcuacaaaacucuaaccgccuacuuuacaaacuacaaagucgacucguccaaccgcgugacauacgacguagucuuccacggguaccuaccgaacgagggagacagcaaaaacagccuccccuacggaaaaauaaacggcacauacaagggaaccgaaaaagagaaaauaaaauucuccuccgaaggcucguucgaccccgaugguaagauaguauccuacgaaugggacuucggagacggcaauaaaagcaaugaggaaaacccagaacacucauacgacaaaguagggaccuacaccguuaaauuaaaagucacggacgacaaaggagagucgagcgucucaaccaccaccgccgagauaaaagaccuauccgaaaacaaacuacccguaaucuauaugcacgucccaaaaucaggcgcacucaaucaaaagguugucuucuauggaaaaggcaccuacgacccggacggcagcauagcgggcuaccaaugggacuuuggcgacgguucggacuucucgucagagcaaaacccuagccauguauacaccaagaaaggagaauacaccguaacccugcgagugauggauucaucuggccaaaugucugagaaaacaaugaaaauaaaaaucaccgacccaguauaccccaucgguaccgaaaaagaaccuaacaacaguaaagaaacugcaagcggacccaucguccccggcauuccugucucaggaaccaucgaaaacaccagcgaucaggacuacuucuacuuugauguaaucacccccggcgaagucaaaaucgacaucaacaaacuaggauacggcggagccacauggguggucuacgacgagaacaauaacgccgucucuuacgcaaccgacgauggacaaaaccucagcgguaaauuuaaagcagacaagcccggacgcuacuacauccaccuauacauguuuaacggcuccuacaugcccuaucgaauuaacauugagggcucaguaggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4555 - RNA, 3413 nt, Artificial Sequence
  mRNA product Design3 comprising derived and/or modified sequence from Clostridium histolyticum__BAA34542.1__ColH (opt8)
gggagagucccgcagucggcguccagcggcucugcuuguucgugugugugucguugcaggccuuauucaagcuuaccaugaaaagaaaaugccuauccaaacgccucaugcuugcaauaacaauggccacaauauuuaccgucaacuccacccuaccaaucuacgccgccguagauaaaaacaacgcaacagcagccguccaaaacgagagcaaacgauacaccguaucauaccucaagacccuaaacuauuacgaucuaguggaccuccucguaaagacggagaucgaaaacuuaccggaucuauuucaauacuccuccgacgcaaaagaguucuacgguaacaagacacgaauguccuucaucauggacgaaaucggacggcgcgcaccccaauacaccgaaaucgaccacaaaggcauacccacccuugucgaaguuguacgagccggcuucuacuuaggauuccacaacaaggaacucaacgaaaucaacaaacgcuccuucaaagaacgagucauccccuccauccucgcuauucagaagaacccaaacuucaagcucgggaccgagguacaagauaagauagucagcgccaccggccugcuggccggcaaugagaccgcgcccccagagguaguaaacaauuucaccccaauccuacaagauugcaucaagaauaucgaccgcuacgcccuggacgaccuaaaauccaaggcccucuucaacgugcuggccgcgcccaccuacgauaucaccgaauaccucagagcuaccaaagagaaacccgagaacacucccugguauggcaagauagacggcuuuauaaacgaacucaaaaagcuagcacuguacggcaagaucaaugauaacaauucauggaucaucgacaacgggauauaccacauugccccguuagguaaacugcacagcaacaauaaaauaggaaucgagacccuaacugaggucaugaaaguauaucccuaucuuagcaugcaacaccuacaauccgcggaccaaaucaagcgccacuacgacagcaaagacgcugaggggaacaaaaucccccuggacaaguucaagaaagagggcaaggagaaauacugcccaaaaaccuacaccuucgacgacggcaaagucauaaucaaagccggcgcgagaguagaggaagaaaaaguaaagcggcucuacugggccagcaaagaagucaacagucaauucuuccgcgucuacggcaucgauaaaccacuagaagagggaaaucccgacgacauacuaacaaugguaauauacaacagcccagaggaguacaaacugaacuccguccuuuacggauacgauacaaacaacgggggaauguauauagaaccggaaggcacauuuuucaccuacgaacgcgaggcccaggaaucaacauauacacucgaggaguuauuccgccacgaauacacccacuaccuacagggacgcuacgcaguaccagggcaguggggccgcacaaagcucuacgauaacgaccgccuaacgugguacgaagaagggggcgccgaacucuucgccggauccacccgcaccagcgggauccuaccgcgaaagaguauagugagcaacauccauaacaccacgcgcaacaaccgcuacaagcucucagacacaguccacagcaaguacggagcaucguucgaguucuacaacuacgcauguauguucauggacuacauguacaacaaagacaugggcauccucaacaaacucaacgaucucgcgaaaaauaacgacgucgacggauacgacaacuauauccgcgaccucucauccaacuacgcacucaacgacaaauaccaagaccacaugcaggaacgaauagacaacuacgaaaauuuaaccguaccauucguagccgacgacuaccuaguacgacacgccuacaaaaacccuaacgaaaucuacuccgagaucuccgaaguugccaaacucaaagaugccaaaucagaagucaagaaaucccaguacuucagcacauucacucugagaggcagcuacacgggcggcgcguccaaaggaaaacuagaagaucagaaagccaugaacaaauucaucgacgacucucuaaagaaacucgacacauacucguggagcgguuacaaaacacugacugccuacuuuaccaacuacaaagucgacaguucaaaucgagucaccuacgacgugguauuucacgguuaccuacccaacgaaggggacuccaaaaacucacuaccuuacggaaaaauaaaugggaccuacaaaggcacagaaaaagagaaaaucaaauucuccuccgaaggcagcuucgacccugacggaaagaucgugagcuaugaaugggacuucggcgacggcaacaaaucaaacgaagaaaaccccgagcauucauaugacaagguaggaaccuacacagucaagcugaaaguaaccgacgacaaaggggaaucaagcguaagcacuaccaccgccgagaucaaggacuuaagcgaaaacaaacugccaguaauuuauaugcacgucccaaaaucaggcgcccuaaaccagaaggugguauuuuacgguaaagggacguacgaucccgacggcagcaucgccggcuaucagugggacuucggugacggcagcgacuucucaagcgaacaaaaccccagccacguuuacacgaaaaagggcgaauacacagugacacuuagagucauggauagcucgggucaaaugagugagaaaacgaugaaaauaaagaucaccgaccccguguaccccaucggcaccgaaaaggaaccgaacaacucaaaagaaaccgccuccgggcccaucguacccgggaucccuguaucuggcacaauagaaaacacaagcgaccaagacuacuucuacuucgacgucauaacccccggcgaagucaaaaucgauaucaacaaacucggauacggcggagcgacauggguaguguacgacgaaaacaacaacgcaguauccuacgccacagacgacggccaaaaccucuccggcaaauucaaggccgacaagcccggacgauacuacauacaccucuacauguucaacggaucauacaugcccuaccggauaaacaucgaaggaucggugggacgguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4556 - RNA, 3347 nt, Artificial Sequence
  mRNA product Design3 comprising derived and/or modified sequence from Clostridium histolyticum__BAA34542.1__HsALB(1-18)_ColH(41-1021) (opt8)
gggagagucccgcagucggcguccagcggcucugcuuguucgugugugugucguugcaggccuuauucaagcuuaccaugaaaugggucacauuuaucagccuccuuuuccuuuucagcucggccuacagcguccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4557 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt8)
gggagagucccgcagucggcguccagcggcucugcuuguucgugugugugucguugcaggccuuauucaagcuuaccaugaaaugggugaccuucauaucacuccuuuuccuauucucaucagcauacucgaugaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4558 - RNA, 923 nt, Artificial Sequence
  mRNA product Design3 comprising derived and/or modified sequence from Homo sapiens__NP_001133.1__HsAMELX (opt8)
gggagagucccgcagucggcguccagcggcucugcuuguucgugugugugucguugcaggccuuauucaagcuuaccaugggcaccuggauccuauucgcaugccuccucggagccgccuucgccaugccccuccccccccaccccggccaccccggcuacaucaacuucucuuacgaaguccucaccccccuaaaaugguaccaaucaauucgcccccccuauccauccuacggcuacgaacccaugggcggcuggcuacaccaccaaauaauacccguccucucccaacaacacccccccacccacacccuccaaccccaccaccacauccccgucguccccgcacaacaacccgucaucccccaacaaccaaugaugccagucccaggccaacacucuaugacccccauccaacaccaccaacccaaccuccccccccccgcacaacaaccauaccaaccccaacccguccaaccacaaccccaccaacccaugcaaccccaaccccccguccaccccaugcaaccccucccaccccaaccaccccucccccccauguuccccaugcaaccccucccccccaugcuacccgaccuaacccucgaagccuggcccuccacagacaaaacaaaacgagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4559 - RNA, 482 nt, Artificial Sequence
  mRNA product Design3 comprising derived and/or modified sequence from Homo sapiens__NP_001133.1__HsAMELX-TRAP (opt8)
gggagagucccgcagucggcguccagcggcucugcuuguucgugugugugucguugcaggccuuauucaagcuuaccaugccccucccaccccaccccggccaccccggauacauaaacuucuccuacgaaguccuaacaccccuaaaaugguaccaauccauacgcccacccuaccccuccuacggcuacgaacccaugggcggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4560 - RNA, 515 nt, Artificial Sequence
  mRNA product Design3 comprising derived and/or modified sequence from Homo sapiens__NP_001133.1__HsAMELX-LRAP (opt8)
gggagagucccgcagucggcguccagcggcucugcuuguucgugugugugucguugcaggccuuauucaagcuuaccaugccccucccaccccaccccggccaccccggcuacauaaacuucuccuacgaaguccucacaccacucaaaugguaccaauccauccgcccaccacccaugcuccccgaccucacccucgaagccuggcccuccaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4561 - RNA, 554 nt, Artificial Sequence
  mRNA product Design3 comprising derived and/or modified sequence from Homo sapiens__NP_001133.1__HLA-A2-SP_HsAMELX(17-60) (opt8)
gggagagucccgcagucggcguccagcggcucugcuuguucgugugugugucguugcaggccuuauucaagcuuaccauggccgucauggcaccccgaacccuaguccuacuccuauccggcgcccuagcccucacccaaaccugggccaugccacuaccaccccacccaggccaccccggcuacaucaacuucuccuacgaaguacucacaccacuaaaaugguaccaauccauccgaccacccuaccccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4562 - RNA, 587 nt, Artificial Sequence
  mRNA product Design3 comprising derived and/or modified sequence from Homo sapiens__NP_001133.1__HLA-A2-SP_HsAMELX(17-47,168-191) (opt8)
gggagagucccgcagucggcguccagcggcucugcuuguucgugugugugucguugcaggccuuauucaagcuuaccauggccguaauggcaccccgaacacucguacuccuccucuccggagcacuagcccucacccaaaccugggccaugccccuccccccacaccccggccaccccggcuacauaaauuucuccuacgaaguccucaccccccucaaaugguaccaauccauccgccccccccccaugcuccccgaccuaacacucgaagccuggcccucaaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4563 - RNA, 926 nt, Artificial Sequence
  mRNA product Design3 comprising derived and/or modified sequence from Homo sapiens__NP_001134.1__HsAMELY (opt8)
gggagagucccgcagucggcguccagcggcucugcuuguucgugugugugucguugcaggccuuauucaagcuuaccaugggcaccuggauccuauucgcaugccuagucggcgccgccuucgccaugccccucccaccccaccccggccaccccggcuacaucaacuucuccuacgaaguacucaccccacucaaaugguaccaauccaugauacgcccacccuacuccuccuacggauacgaacccaugggcggcuggcuccaccaccaaauaauccccgucguuucccaacaacacccccucacccacacccuccaaucacaccaccacauccccguaguccccgcccaacaaccccgaguccgccagcaagcccucaugcccguaccaggccaacaaucaaugacccccacccaacaccaccaacccaaccucccccuccccgcccaacaacccuuccaaccccaacccguccaaccccaaccacaccaaccaaugcaaccccaaccacccguccaacccaugcaaccccuucucccccaaccuccccuaccacccauguucccccuccguccucucccacccauccuccccgaccuccaccucgaagccuggcccgccaccgacaaaaccaaacaagaagaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4564 - RNA, 485 nt, Artificial Sequence
  mRNA product Design3 comprising derived and/or modified sequence from Homo sapiens__NP_001134.1__HsAMELY-TRAP (opt8)
gggagagucccgcagucggcguccagcggcucugcuuguucgugugugugucguugcaggccuuauucaagcuuaccaugccccuaccaccccaccccggccaccccggcuacauaaacuucuccuacgaaguccucaccccacucaaaugguaccaaucaaugauacgaccacccuacuccucauacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4565 - RNA, 518 nt, Artificial Sequence
  mRNA product Design3 comprising derived and/or modified sequence from Homo sapiens__NP_001134.1__HsAMELY-LRAP (opt8)
gggagagucccgcagucggcguccagcggcucugcuuguucgugugugugucguugcaggccuuauucaagcuuaccaugccccuccccccacaccccggccaccccggcuacauaaacuucuccuacgaaguccuaacaccacucaaaugguaccaauccaugauccgccccccccccauacuccccgaccuccaccucgaagccuggcccgccacagacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4566 - RNA, 557 nt, Artificial Sequence
  mRNA product Design3 comprising derived and/or modified sequence from Homo sapiens__NP_001134.1__HLA-A2-SP_HsAMELY(17-61) (opt8)
gggagagucccgcagucggcguccagcggcucugcuuguucgugugugugucguugcaggccuuauucaagcuuaccauggccgucauggccccacgcacacucguccuccuacucucaggagcccucgcacucacacaaaccugggccaugccacucccaccacaccccggccaccccggcuacaucaacuucucauacgaaguccucaccccacucaaaugguaccaaucaaugauacgcccacccuacuccuccuacggcuacgaacccaugggcggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4567 - RNA, 590 nt, Artificial Sequence
  mRNA product Design3 comprising derived and/or modified sequence from Homo sapiens__NP_001134.1__HLA-A2-SP_HsAMELY(17-48,169-192) (opt8)
gggagagucccgcagucggcguccagcggcucugcuuguucgugugugugucguugcaggccuuauucaagcuuaccauggcagucauggcaccccgcacccucguccuacuacucuccggcgcccucgcccucacccaaacaugggccaugccacucccaccccaccccggacaccccggcuacaucaacuucucauacgaaguccucaccccacucaaaugguaccaauccaugauccgacccccacccauccuacccgaccuccaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4568 - RNA, 917 nt, Artificial Sequence
  mRNA product Design3 comprising derived and/or modified sequence from Sus scrofa__NP_999071.1__SsAMELX-001-1 (opt8)
gggagagucccgcagucggcguccagcggcucugcuuguucgugugugugucguugcaggccuuauucaagcuuaccaugggcaccuggauccucuucgcaugccuccucggcgccgccuucuccaugccucuaccaccccaccccggccaccccggcuacauuaacuucuccuacgaaguccuaacuccccuaaaaugguaccaaaacaugauccgacaccccuacaccuccuacggauacgaacccaugggcggauggcuccaccaccaaaucauccccgucgucucccaacaaacaccccaaucccacgcccuacaaccccaccaccacauccccaugguacccgcccaacaacccgguauaccccaacaacccaugaugccccuccccggccaacacucaaugacccccacccaacaccaccaacccaaccuaccccuacccgcacaacaacccuuccaaccccaaccaguccaaccccaaccccaccaaccacuccaaccccaaucccccaugcaccccauccaaccccuccucccacaaccaccccucccacccauguucuccaugcaaucacuccuccccgaccucccccucgaagccuggcccgcaaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4569 - RNA, 485 nt, Artificial Sequence
  mRNA product Design3 comprising derived and/or modified sequence from Sus scrofa__NP_999071.1__SsAMELX-TRAP (opt8)
gggagagucccgcagucggcguccagcggcucugcuuguucgugugugugucguugcaggccuuauucaagcuuaccaugccccuaccaccccacccaggccaccccggcuacaucaacuucuccuacgaaguccucacaccacucaaaugguaccaaaacaugaucagacacccauacaccucauacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4570 - RNA, 518 nt, Artificial Sequence
  mRNA product Design3 comprising derived and/or modified sequence from Sus scrofa__NP_999071.1__SsAMELX-LRAP (opt8)
gggagagucccgcagucggcguccagcggcucugcuuguucgugugugugucguugcaggccuuauucaagcuuaccaugccacuacccccacaccccggccaccccggcuacauaaacuucucauacgaaguacucaccccacucaaaugguaccaaaacaugauccgacaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4571 - RNA, 557 nt, Artificial Sequence
  mRNA product Design3 comprising derived and/or modified sequence from Sus scrofa__NP_999071.1__HLA-A2-SP_SsAMEL(17-61) (opt8)
gggagagucccgcagucggcguccagcggcucugcuuguucgugugugugucguugcaggccuuauucaagcuuaccauggcagucauggcaccccgcacacucguccuccuacuaucaggagcccucgcacucacacaaacaugggccaugccccuaccaccccaccccggacaccccggcuacauaaacuucuccuacgaaguccuaacaccccuaaaaugguaccaaaacaugauccgacaccccuacaccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4572 - RNA, 590 nt, Artificial Sequence
  mRNA product Design3 comprising derived and/or modified sequence from Sus scrofa__NP_999071.1__HLA-A2-SP_SsAMEL(17-49,167-189) (opt8)
gggagagucccgcagucggcguccagcggcucugcuuguucgugugugugucguugcaggccuuauucaagcuuaccauggccgucauggccccacgcacccuaguccuccuccuauccggcgcacucgcacucacacaaaccugggccaugccccucccaccacaccccggccaccccggcuacaucaacuucuccuacgaaguccucacaccccucaaaugguaccaaaacaugauccgccacccaucacuccucccagaccucccacucgaagccuggcccgccaccgacaaaaccaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4573 - RNA, 881 nt, Artificial Sequence
  mRNA product Design3 comprising derived and/or modified sequence from Sus scrofa__P45561-2__SsAMELX-001-2 (opt8)
gggagagucccgcagucggcguccagcggcucugcuuguucgugugugugucguugcaggccuuauucaagcuuaccaugggcaccuggauacucuucgcaugccuccucggcgccgccuucuccaugccccucccaccccaccccggccaccccggcuacaucaacuucuccuacauccgccacccauacaccuccuacggcuacgaacccaugggcggcuggcuacaccaccaaaucauccccgucgucucccaacaaacaccccaaucccacgcccuacaaccccaccaccacaucccaaugguccccgcccaacaaccaggcaucccacaacaacccaugaugccccuacccggccaacacucaaugaccccaacucaacaccaccaacccaaccuaccccuacccgcccaacaacccuuccaaccccaacccguccaaccccaaccccaccaaccccuccaaccccaaucccccaugcaccccauccaaccccuccuaccccaaccaccccucccacccauguucucaaugcaaucccuacuccccgaccuaccccucgaagcauggcccgcuacagacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4574 - RNA, 917 nt, Artificial Sequence
  mRNA product Design3 comprising derived and/or modified sequence from Sus scrofa__NP_998965.1__SsAMELX-001-3 (opt8)
gggagagucccgcagucggcguccagcggcucugcuuguucgugugugugucguugcaggccuuauucaagcuuaccaugggaaccuggaucuucuucgccugccuccucggcgccucccucgcaaugccccucccaccccaccccggccaccccggcuacaucaacuucuccuaugaaguacucacaccccucaaaugguaucaaaacaugauccgccaccccuacacauccuacggcuacgaacccaugggcggcuggcuacaccaccaaaucauacccgucgucucacaacaaacaccccaaucacacgcccuccaaccccaccaccacauccccaugguccccgcccaacaacccggcaucccccaacaacccaugaugccccuaccaggacaacacuccaugaccccaacccaacaucaccaaccuaaucucccccuccccgcccaacaacccuuccaaccccaacccguccaaccccaaccccaccaaccccuccaaccccaaucccccaugcacccuauccaaccccuccucccccaaccaccccucccacccauguucuccaugcaaucacuccuacccgaccucccccucgaagccuggccugccaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4575 - RNA, 566 nt, Artificial Sequence
  mRNA product Design3 comprising derived and/or modified sequence from Sus scrofa__K7GPB2__SsAMELX-002 (opt8)
gggagagucccgcagucggcguccagcggcucugcuuguucgugugugugucguugcaggccuuauucaagcuuaccaugggcaccuggauacucuucgccugccuccucggcgccgcauucucaaugccccucccaccacacccaggccaccccggauacaucaacuucuccuacgaaguacucaccccacucaaaugguaccaaaacaugauccgacaccccucacuccuccccgaccucccccuagaagccuggccagccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4576 - RNA, 959 nt, Artificial Sequence
  mRNA product Design3 comprising derived and/or modified sequence from Sus scrofa__K7GLD0__SsAMELX-003 (opt8)
gggagagucccgcagucggcguccagcggcucugcuuguucgugugugugucguugcaggccuuauucaagcuuaccaugggcaccuggauccucuucgccugccuccuaggcgcugccuucuccaugccacucccaccccaccccggccaccccggcuacaucaacuucuccuacgaagaccuauaccucgaagccauacgcaucgaccgcaccgcauuuguccuaaccccacucaaaugguaccaaaacaugauccgacacccauacaccuccuacggcuaugaacccaugggaggcuggcuacaccaccaaaucaucccagucgucucacaacaaaccccucaaucucacgcccuccaaccacaccaccacauccccaugguccccgcccaacaacccggcaucccccaacaacccaugaugccccuccccggccaacacuccaugacccccacccaacaccaccaacccaaccucccccuccccgcacaacaacccuuccaaccccaaccaguccaaccccaaccacaccaaccccuucaaccccaaucccccaugcaccccauccaaccccuccuaccacaaccacccuuaccucccauguuuucuaugcaaucccuccuccccgaccucccccucgaagccuggcccgccaccgacaaaacaaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4577 - RNA, 845 nt, Artificial Sequence
  mRNA product Design3 comprising derived and/or modified sequence from Sus scrofa__K7GPE9__SsAMELX-004 (opt8)
gggagagucccgcagucggcguccagcggcucugcuuguucgugugugugucguugcaggccuuauucaagcuuaccaugggaaccuggauccuauucgccugccuccuaggagccgccuucucaaugccccuaccaccccaccccggccaccccggcuacaucaacuuuuccuacgaaguccucaccccacucaaaugguaccaaaacaugauacgccaccccacaccccaaucccacgcccuacaaccccaccaccacauccccaugguccccgcccaacaacccggcaucccccaacaacccaugaugccccuccccggccaacacuccaugacccccacccaacaccaccaacccaaccucccccuccccgcccaacaacccuuucaaccccaacccguccaaccccaaccacaccaaccacuccaaccccaaucccccaugcacccaauccaaccccuccucccccaaccaccccucccacccauguucucaaugcaaucacuacuccccgaccucccccucgaagccuggcccgccaccgacaaaaccaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4578 - RNA, 869 nt, Artificial Sequence
  mRNA product Design3 comprising derived and/or modified sequence from Sus scrofa__J9JIM4__SsAMELX-201 (opt8)
gggagagucccgcagucggcguccagcggcucugcuuguucgugugugugucguugcaggccuuauucaagcuuaccaugccucucccaccccaccccggccaccccggcuacaucaacuucuccuacgaaguccucacaccccucaaaugguaccaaaacaugauccgccaccccuacaccucauacggcuacgaacccaugggcggcuggcuccaccaccaaaucauccccgucgucucccaacaaacaccccaaucacacgcacuccaaccccaccaccacauccccaugguccccgcccaacaacccggcaucccccaacaacccaugaugccacuccccggccaacacucaaugacccccacccaacaccaccaacccaaccucccacuccccgcacaacaacccuuccaaccacaacccguacaaccccaaccccaccaaccacuccaaccccaaucccccaugcaccccauccaaccccuacucccccaaccaccccuacccccaauguucucaaugcaaucccuccuccccgaccucccccucgaagcauggccagccacagacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4579 - RNA, 3308 nt, Artificial Sequence
  mRNA product Design3 comprising derived and/or modified sequence from Homo sapiens__NP_006120.1__HsBMP1 (opt8)
gggagagucccgcagucggcguccagcggcucugcuuguucgugugugugucguugcaggccuuauucaagcuuaccaugccaggcguugcaagacuaccacuacucuuaggacuacuacuacuaccgcgaccaggacgaccccucgaccuagcagacuacaccuaugaccucgccgaagaagaugauagcgaaccgcuaaauuacaaagacccguguaaagcagcagcuuuucuaggcgacauagcccuggacgaggaagaccuucgggcguuccaaguacaacaggcaguagauuuacgccgacacacggcucgaaaaucaucaaucaaagcagccguuccaggaaacacgucaaccccaagcugucagucaacaaaugggcaaccccaacgcggagcgugcggacgauggcgaggccgcagcaggucccgcagagcagccaccucccgccccgaaagagucuggcccgauggaguaauaccguucguaauaggcggcaauuucaccggaucccagcgcgcggucuuccgccaagccaugagacacugggagaaacauaccugcgugacauuccucgaaagaacagacgaagacucauacauaguauucaccuaccgaccgugcggcugcugcagcuacguaggccgcagaggcggcgggccacaagcgaucagcaucggcaaaaacugcgacaaauucggaauagucguccacgaacucggccacguaguaggcuucuggcacgagcacacccgaccugaccgagaccgacacgucagcaucguaagagaaaacauacaaccagggcaagaauacaacuuccugaaaauggagccccaagaaguggaauccuuaggagaaaccuacgacuuugacucaaucaugcacuacgcaaggaacacauucucacgaggaauauuccucgacacaauaguucccaaguacgaagugaacgggguuaaaccuccgauuggccaaaggacaagacuaucaaagggcgacaucgcacaggcacgaaaacuguacaaaugccccgcaugcggggagacacuacaagacagcaccgggaacuucucaaguccggaauacccaaacggauacagugcucacaugcacugcguauggcggauaagcgucaccccgggcgagaaaauaauacuaaacuucacaagucuggaccuauaccggagccgccuuugcugguacgauuacguagaaguccgcgacggauucuggcgcaaagcgccacugaggggacgcuucugcggaucaaaacucccggaaccgauaguaucaaccgacucacgccucugggucgaguucagaagcagcucaaacugggucggaaaaggauucuuugcaguguacgaagcuaucugcggaggagacguaaagaaagacuaugggcacauacaaagccccaacuaccccgacgacuaccgcccuagcaaaguuugcaucuggcgcauacaagucagcgaaggcuuccacgucggccugacauuccagaguuucgaaauagaacgccaugacagcugcgccuacgauuaccucgaaguccgcgacggccacucggaaagcagcaccuuaaucggcagguacugcgguuacgaaaaaccagacgacauaaagagcaccucgagccgacucuggcuaaaauucguaagcgacggcagcauaaacaaagcgggcuuugcaguuaacuucuucaaagaaguggacgaaugcuccaggccaaaccgaggcgggugcgaacaaagaugucuaaauacacucggcagcuacaaaugcagcugcgacccgggauacgaacucgcccccgacaaaagaaggugcgaagccgccugcggaggguuccucacaaaacuaaacgggagcaucacuucaccgggauggccaaaagaauacccaccaaauaagaacugcaucuggcaacucgucgcacccacccaauaccgcaucagccuacaauucgacuucuucgaaaccgaaggcaacgacgucugcaaauacgacuucguugaaguccgcuccggacuaacagcagacagcaaacuacacgguaaauucugcggcuccgaaaagccagaagucauaacaagccaauacaacaauaugagagucgaguucaagagcgacaacaccgucagcaaaaagggauuuaaggcacacuucuucucagacaaagacgaaugcucaaaagacaacggcggcugccaacaagacugcguuaacacauucggcucauacgaaugccaaugcagaucagguuucgugcugcacgacaacaaacacgacugcaaagaagccggcugcgaccauaaaguuaccagcaccaguggaaccauaacaagccccaacuggccagacaaauacccaucgaagaaagaaugcacgugggcuaucuccagcacacccgggcaccgggucaaacucaccuucauggaaauggauaucgaaagccaaccggaaugcgcauacgaccaucuagaagucuuugacggccgagacgccaaagccccaguacucggcagauucugcggauccaagaaaccagaaccaguacucgcgaccgggagccgaauguuccuccgcuucuacagcgacaacuccgugcaacgcaaaggcuuccaagccucccaugcgacggaaugcggcggacaaguucgcgcggacgucaaaaccaaagacuuauacagccaugcacaguucggugacaacaauuaccccggaggcguagacugcgaaugggucauaguagccgaagaaggauacggcgucgagcucguauuccagacauucgaaguagaagaagaaaccgacugcggcuacgauuacauggaacuuuucgacggguacgacagcacagcgccacgccucggacgcuacugcggaucaggcccgccagaagaaguauacagcgcaggcgacuccguccuagucaaauuccauucugaugacaccaucacaaagaaaggcuuccacuugagauacacaaguacaaaauuccaagacaccuuacauucaagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4580 - RNA, 1538 nt, Artificial Sequence
  mRNA product Design3 comprising derived and/or modified sequence from Homo sapiens__NP_001191.1__HsBMP2 (opt8)
gggagagucccgcagucggcguccagcggcucugcuuguucgugugugugucguugcaggccuuauucaagcuuaccauggucgccggaacucgcugccuccuagcccuccuacucccccaaguacuacucggcggcgccgccggccucguucccgaacucggacgacgaaaauucgccgccgcauccucuggaaggcccagcucccaacccuccgacgaaguucucuccgaguucgaacuccgccuccucucaauguucggccucaaacaacgccccacaccaucacgcgacgcagucgucccgcccuacaugcucgaccuauaccgucgucacucaggccaacccggaucccccgcccccgaccaccgucucgaacgcgcagccucgcgcgccaacacaguccgcuccuuccaccacgaagaaucccucgaagaacuacccgaaaccuccggcaaaacaacccgacgcuucuucuucaaccucagcuccauccccacagaagaguucauaaccuccgccgaacuacaaguauuccgcgaacagaugcaagacgcccucggaaacaacagcucauuccaccacagaaucaacauuuacgaaauaaucaaacccgccaccgcgaacagcaaauuucccgucacccgucuccucgacacccgccucgucaaccaaaacgccucccgcugggaaucuuuugacguaacacccgcagucaugcgcuggacagcacaaggccacgccaaccacggauucgucguagaaguagcccaccuagaagaaaagcaaggaguauccaaacgucacguacgaauaucacgcucccuacaccaagacgaacacuccuggucccaaauccgaccccuacucgucaccuucggccacgacggaaaaggacacccccuucacaaaagggaaaaacgccaagccaaacacaaacaacgcaaacgacucaaauccucaugcaaaagacacccccucuacguugauuucucagacgucggcuggaacgacuggaucguagccccacccggcuaccacgccuucuacugccacggcgaaugccccuucccccucgcagaccaccuuaauucaaccaaccacgcaaucguccaaacccucgucaacuccgucaacucaaaaauccccaaagccugcugcguccccaccgaacuaucagccaucuccauguuauaccuagacgaaaacgaaaaagugguccucaaaaacuaccaagacauggucgucgaagguugcggcugccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4581 - RNA, 1574 nt, Artificial Sequence
  mRNA product Design3 comprising derived and/or modified sequence from Homo sapiens__NP_001193.2__HsBMP4 (opt8)
gggagagucccgcagucggcguccagcggcucugcuuguucgugugugugucguugcaggccuuauucaagcuuaccaugauacccggcaaccgcaugcucauggucguccuccucugccaaguacuccucggaggagccucacacgccucacucauaccagaaacuggcaaaaaaaaagucgcugaaauccaagggcacgccggcggccgccgcuccggccaaucccacgaacuucuuagagacuucgaagccacccuacuccaaauguucggacuccgccgccgcccccaacccuccaaaucugcaguuauacccgacuacaugcgcgaccuauaccgucuacaaucaggcgaagaagaagaagaacaaauccauaguaccggccucgaauaccccgaacgccccgccucccgcgcaaauacaguccgcucauuccaucacgaagaacaccucgagaacauccccggaacguccgaaaacuccgccuuccgauuccucuucaaccuaucauccauccccgaaaacgaagucaucuccuccgccgaacuccgccuuuuccgcgaacaagucgaccaaggccccgacugggaacgcggcuuccaccgcauaaacaucuacgaaguaaugaaaccacccgccgaggucguccccggacaccuuaucacacgccuccucgacacccgacuaguccaccacaacgucacccgaugggaaaccuucgacguaucccccgcaguccuccgcuggacccgcgaaaaacaacccaacuacggacucgccauagaaguuacacaccuccaccaaacccgaacacaccaaggccaacacguccgaaucucccgcucccucccacaaggcuccggcaacugggcccaacuccgcccccuccucguaaccuucggacacgacggacgcggacacgcccucacccgacgccgccgagccaaacgcucccccaaacaccacucacaaagagccaggaaaaaaaauaaaaauugccgccgccacucacucuacguagacuucagcgacgucggcuggaacgacuggauagucgccccccccggcuaccaagcauucuacugccauggcgacugccccuucccacucgccgaucaccuaaacagcaccaaccacgccauaguccaaacccuaguaaacuccgucaacuccagcauacccaaggcaugcugcguacccacagaacugagcgcaaucuccauguuauaccucgacgaauacgacaaaguaguacucaaaaacuaccaagaaaugguaguagaaggaugcggcugccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4582 - RNA, 1889 nt, Artificial Sequence
  mRNA product Design3 comprising derived and/or modified sequence from Homo sapiens__NP_001709.1__HsBMP6 (opt8)
gggagagucccgcagucggcguccagcggcucugcuuguucgugugugugucguugcaggccuuauucaagcuuaccaugcccggauuaggucgccgagcacaguggcucugcuggugguggggacuccucuguagcugcugcggaccccccccccuacgcccaccucuccccgccgcugccgccgccgccgccggcggccaacuacucggagacggcggaucacccggccgaacugaacaaccaccccccucaccccaauccucaagcggguuccucuaccgucgccugaaaacccaagaaaaacgcgaaaugcaaaaagaaauccuauccguccucggccucccccaccgcccccgcccccuacacggacugcaacaaccccagccaccagcccuacgucaacaagaagaacagcagcaacaacaacaauuaccaagaggagaaccacccccuggccgacugaaauccgccccacuauucaugcucgaccuauacaacgcacucagcgcagacaaugacgaagacggcgcaucagaaggagaaagacaacaaucauggccacacgaagcagccucaagcucccaacgaagacaaccaccacccggagcagcgcacccccuaaaccgcaaaucccuacuggcccccggauccggcagcggcggcgccuccccacuaaccagcgcccaagacucugcauuccuuaacgacgcagacauggucaugucauucguuaaccuggucgaauacgacaaagaauucucgccccgacaacgacaucacaaggaauucaaauucaaccucagccagauacccgaaggcgaaguagucaccgccgccgaguuccgcaucuauaaagacugcgucaugggaucauucaaaaaccaaacauuccuaaucuccaucuaccaaguacuccaagaacaccagcaccgcgacagcgaccucuuccuauuagacacccgcguagucugggccucagaagaaggcuggcucgaauucgacauaacugccaccucaaaucuuugggucgucacaccacaacacaacaugggccuccaacucuccguagucacccgugacggaguccacguacacccccgagcugccggccucgucggacgagacggccccuacgacaaacaacccuucauggucgcauucuucaaagucuccgaaguccacguccgaaccacccgcucagccuccucccgucgcaggcaacaaucccgaaaccgauccacacaaucccaagauguagccagaguauccuccgccuccgacuauaacuccuccgaacucaaaacagcaugccgcaaacacgaacucuauguauccuuccaagaccuuggauggcaagacuggaucaucgccccaaaaggauacgccgccaacuacugcgacggcgaauguucauucccucuaaacgcccacaugaacgcaaccaaccacgccaucguacaaacacuuguccaccucaugaaucccgaguacguccccaaacccugcugcgcacccaccaaacucaacgccauaucagucuuauacuucgacgacaacucaaacguaauccugaaaaaauaccgcaacauggucguucgcgcaugcggcugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4583 - RNA, 1643 nt, Artificial Sequence
  mRNA product Design3 comprising derived and/or modified sequence from Homo sapiens__NP_001710.1__HsBMP7 (opt8)
gggagagucccgcagucggcguccagcggcucugcuuguucgugugugugucguugcaggccuuauucaagcuuaccaugcacguccguucccugagagccgccgccccccacucguuugucgcccuaugggcaccccuauuccuccuucgaucagcacuugcagacuucucccuugacaacgaaguccacucguccuucauccaccgccgccucagaucacaagaacgacgagaaaugcaacgcgaaauacuuagcauccuaggccucccccaccguccccgaccacaucuccaaggcaaacacaacucagccccaauguucaugcucgaccucuacaacgccauggccgucgaagagggcggcggacccggcggucaaggcuucuccuacccauacaaagccgucuucagcacucaaggaccaccccucgcuucccuucaagacucccacuuccuaaccgacgcagauauggucauguccuucgucaaccuagucgagcacgacaaagaauucuuccacccccgcuaccaccaccgagaauuccgcuucgaccucuccaaaauacccgaaggcgaggccgucacagcugccgaauuccgcaucuacaaagacuacauccgcgaacgcuucgacaacgaaaccuucaggaucucagucuaucaaguccuacaagaacaucucggccgcgaauccgacuuauuccuccuagacucacgcacccucugggccucagaagaaggauggcucguauucgacaucacagccacaucaaaccacugggucgucaacccccgccacaaccucggccugcagcuaucaguagaaacccucgacggacaauccaucaaccccaaacucgccggucucaucggccgacacggcccacaaaacaaacagcccuucauggucgccuucuucaaagccaccgaaguccacuuccgaagcauccgcuccaccggauccaaacaacgcucccagaaucguuccaaaaccccgaaaaaccaagaggcccuacgcauggccaacgucgcagaaaacuccucaucagaccaacgccaagccugcaaaaaacacgaacuauacgucuccuuccgcgaccucggauggcaagacuggaucaucgcaccagaaggcuacgccgccuacuacugugaaggagaaugcgccuuuccucucaacuccuacaugaacgccaccaaccacgcaauuguacaaacccuaguucacuucaucaacccagaaacagucccaaaacccugcugugcccccacacaacuaaacgcaauauccguccucuacuucgacgauuccucgaacguuauccucaaaaaauaccgcaacaugguaguccgagccugcggaugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4584 - RNA, 647 nt, Artificial Sequence
  mRNA product Design3 comprising derived and/or modified sequence from Homo sapiens__NP_006264.2__HsCCL7 (opt8)
gggagagucccgcagucggcguccagcggcucugcuuguucgugugugugucguugcaggccuuauucaagcuuaccaugaaagccucagccgcccuccucugccuccuccucacagcagccgccuucuccccccaaggccucgcccaaccagucggcaucaacaccuccacaaccugcugcuaccgcuucauaaacaaaaaaauacccaaacaacgccuagaauccuaccgcagaaccacauccucacacugcccccgcgaagccgucaucuucaaaaccaaacuagacaaagaaaucugcgccgaccccacccaaaaauggguccaagacuucaugaaacaccuagacaaaaaaacacaaacccccaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4585 - RNA, 3971 nt, Artificial Sequence
  mRNA product Design3 comprising derived and/or modified sequence from Homo sapiens__NP_001954.2__HsEGF (opt8)
gggagagucccgcagucggcguccagcggcucugcuuguucgugugugugucguugcaggccuuauucaagcuuaccaugcuguuaacgcuaaucauccuacuaccagucguaagcaaguucucuuuugucucccugagcgcgccccagcauugguccugcccagaaggcacccucgcaggcaauggaaacagcacaugcguaggcccggcuccauuccuaaucuucagccauggcaacagcaucuuuagaaucgacaccgagggcaccaacuacgaacaacucgugguagaugccggagugagcguaauaauggacuuccacuacaacgaaaaacgcauauauugggucgaccuagaacggcagcuccuccaaaggguauuucucaacggaucccgacaggagcgggugugcaauaucgagaaaaacgucuccggaauggcaaucaacuggaucaacgaagaagucaucuggagcaaucagcaggaaggaaucauaacagucacugauaugaagggcaauaacucccacauacuacucucagcacuaaaauaccccgccaacguagcaguagauccuguggaacgcuucaucuucuggagcucagagguagccgguagccucuacagagcggaucuugacggagugggugugaaagcacuuuuagaaacaagcgagaaaauaaccgcaguaucccuugacgugcucgacaaacgacuauuuuggauucaguacaaucgggaaggcucgaacucccuaauaugcucgugcgauuacgacggcggaagcguacacauaagcaagcaccccacgcagcacaaccucuuugcaaugucccuguucggugaccgaaucuucuacuccaccuggaaaaugaagaccauauggaucgcgaacaaacauacagggaaagauauggucagaaucaaccuacacagcuccuucgucccccuaggagaacuaaaggucguacauccacucgcccaacccaaagcggaagacgacaccugggaaccggaacaaaaauugugcaaauuaagaaaggguaauugcuccagcacugucugcgggcaagaccuccaaucacaccucugcaugugcgcggaaggguaugcccugagccgggaccgcaaauauugcgaagacgucaaugaaugcgccuucuggaaccacggauguacgcuugguugcaaaaacacacccgggagcuacuacuguaccugccccguaggcuucguccuacugccggacggcaagcggugucaucagcuagucaguugcccacgcaacguuucagaaugcagccacgacugcguccuaacauccgagggaccacucuguuucugcccagaaggcucagugcuagaaagagacggaaaaacaugcagcgggugcucaagcccagauaauggcgggugcucgcaacuaugugugccacuauccccugucuccugggaaugcgacugcuuccccggauacgaucuccaacucgacgaaaagucaugcgccgccaguggcccccaacccuuucuucuauucgccaacagccaagacauucgccacaugcacuucgacggaacagacuacggaacccucuuaucucaacagaugggcaugguuuacgccuuagaucacgacccuguggaaaacaaaauauacuucgcccacacagcacuaaaauggaucgaaagagcaaauauggacggcucacaacgagaacgccucauagaagagggcguagacguacccgaaggccuagcgguugacuggauaggcagaagguucuacuggacugaccgaggcaagucucugauagggcgcucggaccugaacggcaaacgcuccaaaaucauaacaaaggagaacaucucccaacccagaggaaucgcaguucacccaauggccaaacgacuguucuggaccgacacuggaaucaacccgcggaucgaaucuuccagucuacaggggcuggggcgucucguuauugcaucgagcgaccugauauggcccagcggcauaacgauagacuuccugacagacaaacuguacuggugcgacgcaaaacaaagcgugaucgaaauggccaaucucgacggaucaaaaagacgcagacucacacagaacgacgugggccacccuuucgcuguagccguauucgaagacuacgucugguucucagacugggccaugcccagcguaaugcgaguuaacaaacgcaccgguaaagacagaguccgucuccaaggcucaaugcuaaagccuaguucccuuguaguaguacauccacuagcuaaacccggugcagacccgugccuauaccagaacgguggaugugaacacauuugcaaaaagcgauugggaaccgccuggugcagcuguagagaaggauucaugaaagcgagugacggaaaaacaugccucgcacucgacggccaccagcuccuagccggaggggaaguagaucucaaaaaccaagugacgcccuuagacauacuaagcaaaaccagaguaucggaggacaacaucacggagagccaacacaugcuuguagcugaaaucaugguaagcgaccaagacgauugcgcgccagucggaugcagcauguacgcacggugcaucuccgaaggugaagaugcuaccugccagugccuaaaaggauuugcgggagacggcaaacuauguagcgauaucgacgaaugcgaaaugggagucccugucuguccgccagcaagcuccaaaugcaucaacaccgagggagguuacguaugccgaugcuccgagggauaucaaggagacggcauacacugccucgacauagacgaaugccaacugggagagcacuccugcggcgaaaacgcaagcuguaccaacacagagggcggcuacacaugcaugugcgccggccgccuaucugaacccggacucaucugccccgacucgaccccuccuccgcaccuacgugaggacgaccaccauuacagcgugcgaaauuccgacucggagugcccccuaucccacgacggauacugccuucaugacggcgucugcauguauaucgaagcccuagacaaauacgcguguaauugcguugucggcuacaucggggaacgaugccaguaccgcgaccuaaaauggugggaacuaaggcacgccgggcauggccagcagcagaaagucauagucguggcagucugcguaguggugcucgucaugcuacuccuacuaucacucuggggagcgcacuacuaccgcacccaaaaacuucuaagcaaaaaucccaaaaacccauacgaggaaucaagccgggauguucgaucgaggcgaccagcggacacagaagauggcaugagcucgugcccgcagcccugguucguggugaucaaggagcaucaagaccugaaaaacgggggacaaccaguagccggugaagacggccaagcagccgacgguagcaugcagccaaccucauggagacaagaaccacaacucugcgguaugggcacagaacagggcugcuggauucccgucucauccgacaagggcagcugcccccaaguaauggagcgauccuuccacaugccaagcuacggaacgcagacccuagaaggcgggguagaaaagccgcauucccugcugucugccaacccccuguggcaacagcgcgcacucgacccaccucaccagauggaacucacacaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4586 - RNA, 857 nt, Artificial Sequence
  mRNA product Design3 comprising derived and/or modified sequence from Homo sapiens__NP_001423.1__HsEREG (opt8)
gggagagucccgcagucggcguccagcggcucugcuuguucgugugugugucguugcaggccuuauucaagcuuaccaugaccgccggccgacgaauggaaaugcucugcgccggccguguccccgcacuucuccucugccucggauuccaccuacuccaagccguccucuccaccaccgucauccccucaugcauccccggagaauccuccgacaacugcaccgcccuaguacaaacagaagacaacccccgcgucgcacaaguuuccaucaccaaaugcuccucagacaugaauggcuacugccuccacggacaaugcauauaccuagucgacaugucccaaaacuacugccgcugugaagucggauacacaggcguccgcugcgaacacuucuuccucaccguccaccaaccccuauccaaagaauacgucgcccucaccgucauccucauaauccuauuccucaucacaguugucggcuccaccuacuacuucugccgcugguaccgcaauagaaaauccaaagaaccaaaaaaagaauacgaacgcguaaccucaggcgaccccgaacucccacaagucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4587 - RNA, 815 nt, Artificial Sequence
  mRNA product Design3 comprising derived and/or modified sequence from Homo sapiens__NP_000791.1__HsFGF1 (opt8)
gggagagucccgcagucggcguccagcggcucugcuuguucgugugugugucguugcaggccuuauucaagcuuaccauggcagaaggcgaaauaaccacauucaccgcccucaccgaaaaauucaaccuccccccaggcaacuacaaaaaaccaaaacuccuauacugcuccaacggcggacacuuccuccgcauccuccccgacggcacagucgacggaaccagagaccgcucagaccaacacauccaacuccaacucuccgccgaaucagucggagaaguauacaucaaaagcaccgaaaccggacaauaccuagccauggacaccgacggcuuacucuacggcucacaaacccccaacgaagaaugccucuuccucgaacgccucgaagaaaaccacuacaacacauacaucuccaaaaaacacgcagaaaaaaacugguucgucggccucaaaaaaaacggcuccugcaaacgcggcccccgcacccacuacggccaaaaagccauacucuuccucccccuccccgucucaucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4588 - RNA, 1214 nt, Artificial Sequence
  mRNA product Design3 comprising derived and/or modified sequence from Homo sapiens__NP_001997.5__HsFGF2 (opt8)
gggagagucccgcagucggcguccagcggcucugcuuguucgugugugugucguugcaggccuuauucaagcuuaccaugguggggguagggggaggggauguggaggauguaacgccgaggccagggggaugccaaauaaguggaagaggggccaggggauguaacgggaucccgggagcggcagcgugggaggcagcgcugccgagaaggagaccgagaaggcacccgagugugaacccgaggagcagggcggcagggagcccgagaacaagagggagaaggacagaggaaagaccaucggggagcagguugggggaucgagggcgaggaagggcgcugccgggagggagauugggagggagagggagggggagagcgccagagagggugggaggaagggggagaggaagagggacggcggcaccgagggcggcgccggcggcaaggggaagcagaccagggccggcgggaacgauggcggcggggagcauaacgacgcuaccagcauugcccgaagacggaggaucgggcgcauucccgccagggcauuuuaaagauccgaagaggcuguacuguaaaaauggaggguucuuucugagaauacauccggauggacggguagauggagugagagagaagagugacccgcacauaaaguugcaacugcaagcggaagagagaggaguagugagcauaaaagggguaugugccaacagauaucuagcaaugaaggaagauggaaggcuacuggcaagcaaguguguaacggacgagugcuuuuucuucgaaaggcuagagaguaacaacuauaacacguacagaagcaggaaauauacaaguugguauguggcgcuaaagaggacgggacaauacaagcuggggagcaagacagggccggggcaaaaggcaauacuguuuuuaccaaugagugcgaagaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4589 - RNA, 932 nt, Artificial Sequence
  mRNA product Design3 comprising derived and/or modified sequence from Homo sapiens__NP_002000.1__HsFGF7 (opt8)
gggagagucccgcagucggcguccagcggcucugcuuguucgugugugugucguugcaggccuuauucaagcuuaccaugcacaaauggauccuaaccuggauccuacccacccuucucuaccgauccugcuuccacaucaucugccuaguaggaaccaucucacucgcaugcaacgacaugacacccgaacaaauggccaccaacgucaacugcuccuccccagaacgccacacacgcagcuacgacuacauggaaggcggagacauccgcguccgccgccucuucugccgaacacaaugguaccuccgcaucgacaaacgcggcaaaguaaaaggcacacaagaaaugaaaaacaacuacaacaucauggaaauacgcacaguagccgucggaaucguagcaaucaaaggcgucgaauccgaauucuaccucgccaugaacaaagaaggcaaacuauacgccaaaaaagaaugcaacgaagacugcaacuucaaagaacucauccuagaaaaccacuacaacacauacgcaucagccaaauggacccacaacggaggcgaaauguucgucgcccucaaccaaaaaggcauccccgucagaggcaaaaaaaccaaaaaagaacaaaaaacagcacacuuccuccccauggccaucaccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4590 - RNA, 974 nt, Artificial Sequence
  mRNA product Design3 comprising derived and/or modified sequence from Homo sapiens__NP_001936.1__HsHBEGF (opt8)
gggagagucccgcagucggcguccagcggcucugcuuguucgugugugugucguugcaggccuuauucaagcuuaccaugaaacuacuccccuccgucguccuuaaacucuuccucgccgccguacucuccgcacucgucacaggcgaaucacucgaacgacuccgccgaggccucgccgcaggcaccucaaaccccgaccccccaaccguguccacagaccaacuacuaccacucggcggaggacgcgaccgcaaaguccgcgaccuccaagaagcagaccuagaccuccuccgagucacccucuccuccaaaccccaagcccuagccacccccaacaaagaagaacacggcaagcgaaaaaaaaaaggcaaaggccuaggcaaaaaacgcgacccaugccuacgcaaauacaaagacuucugcauccacggcgaaugcaaauacguaaaagaacuccgagccccaucaugcaucugccaccccggcuaccacggagaacgcugccacggccuaucccuacccgucgaaaaccgccucuacaccuacgaccacacaacaauccucgccgucgucgcagucguccucucauccguaugccuccucgucaucgucggccuacucauguuccgcuaccaccgacgaggcggcuacgacgucgaaaacgaagaaaaagucaaacucggaaugacaaacucccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4591 - RNA, 2534 nt, Artificial Sequence
  mRNA product Design3 comprising derived and/or modified sequence from Homo sapiens__NP_000592.3__HsHGF (opt8)
gggagagucccgcagucggcguccagcggcucugcuuguucgugugugugucguugcaggccuuauucaagcuuaccaugugggucaccaagcuacuccccgcucuccugcuacaacacguccugcuccaccuccuacuccuccccauagccauaccauacgccgaaggacaacgcaagcgccguaauacaauacaugaguucaagaaaagcgccaaaaccacccuuaucaaaaucgaccccgcccuaaaaaucaagaccaaaaaggugaacaccgccgaccaaugcgccaacagaugcaccagaaacaagggccuccccuucacaugcaaagccuucguauucgacaaggcccgcaaacaaugccuaugguucccauucaacuccauguccuccggcgucaagaaagaguucggccacgaauuugaccucuacgaaaauaaagacuacauccgaaacugcaucaucggcaaaggacgcucauacaaaggcaccguauccaucaccaaaucaggcauaaaaugccaacccuggagcucaaugaucccccacgaacacucauuucuaccauccuccuaccgaggcaaagaccuccaggaaaauuacugcaggaacccgcgcggggaagaaggcggacccuggugcuuuaccuccaaccccgaaguacgguacgaagucugcgacauaccccaaugcuccgaaguagaaugcaugacaugcaacggagaauccuaucggggccucauggaucacacagaaucagguaaaaucugccagcgcugggaccaccagaccccucaccgccauaaauuccucccagaacgcuacccagacaaaggguucgacgacaacuacugcagaaacccugacggccagccacgcccaugguguuacacacuagacccccacacccgaugggaauacugcgccaucaaaacaugugcagacaauacaaugaaugacaccgacgucccacucgaaaccaccgaaugcauccaagggcagggagaaggauaccgaggcacggucaacaccaucuggaacggcauacccugccaacggugggacagccaauauccgcacgaacacgacaugacuccagaaaacuucaaaugcaaagaccucagagagaacuacugcagaaaucccgacggauccgaaucacccuggugcuucaccacggaccccaacauccgcguaggcuacugcucacaaauaccaaacugcgauaugagccacggucaagacugcuaucgcggcaacggcaaaaacuacaugggaaaccucucacagacccgcucaggccuaacguguagcaugugggacaaaaacauggaggaccuucaucggcacaucuucugggaacccgacgcauccaaacuuaacgagaacuacugccgaaacccagacgacgacgcccacgggccauggugcuacacaggcaacccacucaucccgugggacuauugccccauaagccgcugcgagggcgacacaaccccaacaaucgugaaccuggaccacccugucaucucgugcgcaaaaacaaaacagcuucgggucgucaacggcaucccaacacgaacaaacauaggguggauggucucucuacgcuacagaaacaaacacaucugcggcggcucacucaucaaagaaagcuggguccucacagcucgccaaugcuucccaucaagagaccucaaagauuacgaagccuggcuaggcauacacgacguacauggaaggggagacgaaaaaugcaaacaaguacuuaacguaagccaacucgucuauggcccagaaggaagcgaccucguccucaugaaacuagcacgcccagccguccucgacgacuuuguaagcaccauagaccuccccaacuauggcugcaccaucccagagaaaacgaguugcucagucuacggcuggggauacacgggacugaucaauuacgacggacuacuccgggucgcacaccucuacaucaugggcaacgaaaaaugcucccaacaccaccgcggcaaaguaacucucaacgaaagcgaaaucugcgccggagccgagaaaaucggcucaggcccaugcgaaggcgacuacggcggaccccuuguuugcgaacaacacaaaaugaggaugguacucggcguaauaguucccggcagggggugcgccaucccaaaccgacccggaauauuugucagaguagcauacuacgcgaaauggauucacaaaaucauacuaaccuacaaagucccccagucguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4592 - RNA, 2273 nt, Artificial Sequence
  mRNA product Design3 comprising derived and/or modified sequence from Homo sapiens__NP_005336.3 __HsHSPA1A (opt8)
gggagagucccgcagucggcguccagcggcucugcuuguucgugugugugucguugcaggccuuauucaagcuuaccauggccaaagccgccgcaaucggcauagaccucgguacgacguacagcugcguaggcgucuuccaacacggcaagguggaaauaaucgcuaacgaccaaggcaacagaaccacaccgucguacgucgcauucaccgacaccgaacgacucaucggggacgcggccaaaaaccaagucgcacuaaacccccaaaacacaguguucgacgccaaacgacucaucgggagaaaauucggcgaccccguaguccaguccgacaugaaacacuggcccuuccaaguaaucaacgacggagauaaacccaaaguacaagucagcuacaaaggagagaccaaggccuucuacccagaggaaaucucaagcauggugcugacaaaaaugaaagaaaucgcagaagccuaccuaggauacccagucacgaacgccgucaucaccguccccgcauacuucaacgacagccaaagacaggccaccaaagacgccggagucaucgcaggacucaauguccuacgaauaauaaacgagccaaccgcagccgccauagcauacggacucgaccgaacaggcaaaggagaacgcaacguccuaaucuucgaccucgggggcgggaccuucgacgucuccauccuaacaauagaugacggcaucuucgaagugaaagccaccgccggcgacacacaccucgggggagaagacuucgacaaccgccucguaaaccacuucgucgaagaauuuaagcgaaaacacaagaaagacaucagccaaaauaagcgcgcggugcgacgccugagaaccgcaugcgagcgagccaaacgaacgcucucauccucaacccaagcgucacucgaaaucgacucacucuucgagggaaucgacuucuacaccucaaucacgcgagcccgcuucgaagaauuaugcucagaccucuuccgaucaacacuagaacccgucgaaaaagcccucagagaugcaaaacuggacaaagcacaaauccaugaccuuguccuaguaggaggcucaaccaggauccccaaaguacaaaaacugcuccaagacuucuucaaugggcgagaccucaacaaguccauaaaccccgacgaagcagucgcauacggggcagcaguccaagcagcaauauuaaugggcgacaagucggaaaacguccaagaccuccuacuacuagacgucgcgccacuaagucuagggcucgaaaccgcgggaggcgucaugacugcccuaaucaaacgcaacuccaccauccccacaaaacaaacccaaauauucaccacauacuccgacaaccaaccaggaguacugauacaaguauacgaaggcgaacgagccaugaccaaagacaacaaccuacuaggacgcuucgaacucagcggaaucccacccgcccccagaggaguaccccaaauagaagucacauucgacaucgacgcaaacggcauccuaaacguuacagcgaccgacaaauccaccggaaaagcaaacaagauaacgaucacaaacgacaaaggcagacucuccaaagaggagaucgagagaaugguccaagaagcagagaaauacaaagcagaagacgaaguccaacgugaacgcgucagcgccaagaacgcacucgagucguacgccuucaacaugaaaagcgccgucgaggacgaaggacucaaggggaaaaucucagaagccgacaaaaagaaaguacucgacaaaugccaagaaguaaucagcuggcuagaugccaacacacucgccgaaaaagacgaguucgaacacaaacgcaaagaauuagaacaagucuguaaccccaucaucuccggacucuaccaaggcgcaggcggaccaggccccggcggcuuuggcgcacaaggccccaaaggcggcagcgguuccggccccacaauagaagaaguagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4593 - RNA, 2273 nt, Artificial Sequence
  mRNA product Design3 comprising derived and/or modified sequence from Homo sapiens__NP_005337.2 __HsHSPA1B (opt8)
gggagagucccgcagucggcguccagcggcucugcuuguucgugugugugucguugcaggccuuauucaagcuuaccauggcaaaagcggcagcaaucggaaucgacuuaggcaccaccuacucgugcgugggagucuuccaacacggcaagguggaaaucaucgcaaacgaccagggcaaccgcaccacccccagcuacguagccuucacagacaccgaacgccugauaggagacgcagcgaaaaaccaggucgcacucaacccacaaaacacagucuuugacgcaaaacggcucauaggaagaaaauucggcgacccggugguccagagcgacaugaaacacuggcccuuccaggugauuaacgacggagacaagccgaaaguccaagucucguacaaaggcgaaaccaaggcauucuacccggaagaaaucuccuccaugguccuaaccaaaaugaaagaaauagccgaagcauaccucggcuaccccgucaccaacgcgguaauaaccguccccgcauacuuuaacgacagucaacgucaggccaccaaagacgcaggggucauagcagggcucaacguccuccgaaucaucaacgaacccaccgcagcagccauagcauacggucucgaccgcacaggcaaaggcgaacgaaacguccuaaucuucgaccuaggugggggcaccuucgacgucucaauccuaacaauagacgacggcauauucgaaguaaaggcaaccgcaggcgacacccaccuaggcggcgaagacuucgauaaccggcucgugaaccacuucgucgaagaguucaaacgcaagcacaagaaagacauaucgcaaaacaaacgagcaguaaggcgacuccgaaccgcgugcgaacgagcaaaaagaacccuaagcucgagcacgcaggccagccucgaaauagacucccucuucgaagggaucgacuucuacacaucaauaacacgagcacgauucgaagaacucugcagcgaucuauuucgcucaacccucgagccggucgaaaaagcccuccgcgacgcgaaacuagacaaagcccagauacacgaccuaguccuaguagggggaucaaccaggauaccaaaaguacaaaaacuacuccaagacuucuucaacgggcgcgaccugaacaaaucuaucaacccagacgaagccgucgcguacggcgccgcuguccaagccgcaauucugaugggagacaaaagugaaaacguacaagaucuccugcuacuagacguagccccacuaucacugggauuagaaaccgcgggcggagucaugaccgcccuaauaaaaagaaacucaacaaucccaacgaaacaaacacaaaucuucaccaccuacagcgacaaccaacccggagugcucauccaaguguacgaaggcgaacgcgcaaugacaaaagacaacaaccuccuaggaagauucgaacuauccggcaucccaccagccccacgcggagucccacagauagaagucacauuugacauagacgcgaacggaauacuaaacguaacagcgaccgacaaaucgacgggcaaggcaaauaaaauaaccaucacgaaugacaaagggcgccuaagcaaggaagagaucgaaagaauggugcaggaagccgaaaaguacaaggccgaggacgaaguccaaagagaacgggucagcgccaaaaacgcacuagaaucguacgccuucaacaugaaauccgcggucgaagacgaaggacucaaaggaaaaauaagcgaagcugacaaaaagaaaguacucgacaaaugccaagaaguaaucuccuggcucgacgcaaacacauuagccgagaaggacgaguucgaacacaaacgaaaagaacuugaacaaguaugcaaccccauuauuucaggccuauaccaaggagcaggagggcccgggcccggaggcuucggcgcgcaaggcccaaaaggaggauccggaagcggaccgacaaucgaagaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4594 - RNA, 2273 nt, Artificial Sequence
  mRNA product Design3 comprising derived and/or modified sequence from Homo sapiens__NP_005518.3 __HsHSPA1L (opt8)
gggagagucccgcagucggcguccagcggcucugcuuguucgugugugugucguugcaggccuuauucaagcuuaccauggcaaccgccaagggcaucgccaucgggauagaccucggaacaaccuacucaugcgucggagucuuccaacacggcaaaguggagauaaucgccaacgaccaaggaaaccgaacgacacccucauacguggcguucacagauacagagcgguuaaucggcgacgcagccaaaaaccaagucgccaugaacccacaaaacacggucuuugacgccaaaaggcuaauuggcagaaaauucaacgaccccguaguccaggccgacaugaaacucuggcccuuccaagucauaaacgaaggcggcaaacccaaaguccuagucucauacaaaggcgaaaacaaagcauucuacccggaagaaaucucgagcauggucuuaacaaaauuaaaagaaacggccgaagcauuccuuggacaccccgucacgaacgcaguaaucacaguccccgcauacuucaacgacucccaacgccaggcgacaaaagacgccggggucauagccggccuaaacguucugaggauaaucaacgagccgaccgccgcagccauagcguacggacuugacaaaggaggacaaggcgaacgccacguacucaucuucgaccugggcggcggcaccuuugacgucuccaucuuaaccaucgacgacggcaucuucgaaguaaaagccacggccggagacacacaccuuggcggagaagacuucgacaaccggcucgucagucacuuugucgaagaguucaagcgcaaacacaagaaagauaucucgcaaaacaaaagagcaguccgaagacuccgcaccgccugcgaacgcgccaagagaacacucagcagcucaacacaggcaaaccuggaaaucgacucacucuacgaaggcauagacuucuacaccucaauaacacgagcgcgcuucgaagaacuaugcgccgaccucuucagagggacccuggaaccggucgaaaaagcccuccgagacgccaaaauggacaaagcaaaaauccacgacauaguccuaguaggugggucaacccgaauccccaaagugcaacgacuccuccaagacuacuucaacgggcgcgaccucaauaaaucaaucaaccccgacgaagcaguagcauacggcgcagcaguccaagcagcgauccuaaugggggacaagagcgaaaaaguccaggaucuccuccuccuugacgucgcaccucuaucucuaggacuagaaaccgcaggggguguaaugacagcacucaucaaaagaaacucaacaauacccaccaaacaaacacaaaucuucacaaccuacuccgacaaccaaccaggaguacuaauacaagucuacgaaggggaacgcgccaugaccaaagacaacaaccuccugggccguuucgaccuaaccgguaucccaccagcaccacgcggaguaccgcaaauagaagugacguucgacauagacgcaaacggaauccucaacgucaccgcgaccgacaaaucaaccggcaaagugaacaaaaucaccaucacaaacgacaaagggcgauuaagcaaagaagaaaucgaacgaaugguccucgacgcagaaaaauauaaggccgaagacgaaguccaacgagagaaaauagccgccaaaaacgcauuagaaucauacgccuucaauaugaaaagcguaguaucagacgaaggccuaaaaggcaaaaucagcgagagcgacaaaaacaagauacuagacaaaugcaacgaacuccuaagcuggcucgagguaaaccaacucgcagaaaaggacgaguucgaccacaaaagaaaagaacuagagcaaauguguaacccaaucauaacaaaauuauaccaaggaggcugcacggggcccgccugcggaacaggcuaugucccaggaagacccgccaccggccccacgauagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4595 - RNA, 2267 nt, Artificial Sequence
  mRNA product Design3 comprising derived and/or modified sequence from Homo sapiens__NP_068814.2 __HsHSPA2 (opt8)
gggagagucccgcagucggcguccagcggcucugcuuguucgugugugugucguugcaggccuuauucaagcuuaccaugagcgcccggggacccgcaaucggcaucgaccuaggaaccacauacagcugcguaggcguguuccaacacggaaaagucgagauaaucgccaacgaccaaggaaaccgaaccaccccaucauacguagcguucaccgacaccgaaagacucaucggggaugcagcgaagaaccagguggcuaugaaccccacaaacacaaucuucgacgccaaacgccuaauagggagaaaauucgaagacgcaacaguccaaucagacaugaaacacuggcccuucagggucgucucagaaggaggaaaacccaaaguacaagucgaauacaaaggcgaaacaaaaacguucuucccagaagagaucucauccaugguccucacaaagaugaaggaaauagccgaagccuaccuaggcggcaaaguccacagcgcagucauaaccguaccagcauacuucaacgacagccaacggcaagccacaaaagacgcaggaaccaucaccggguuaaacguacuacgaauaauaaacgaacccacagcagcagccaucgcguacggccucgacaagaaaggcugcgccggaggcgagaaaaacguacucaucuucgaccucggcggaggcacauucgacguaucgauacucacaauagaagacggcauauucgaagucaaaucaaccgccggagauacacaccuuggaggggaggacuucgacaacagaauggugagccaccuagcagaggaguucaaacgaaaacacaagaaagacauaggacccaacaaaagggccguacgcagacucagaacagcaugcgaaagagccaaacgaacacuaucauccuccacacaggccagcauagaaauagacucacuauacgaaggagucgacuucuacaccagcaucacacgcgccagauucgaagaacucaacgccgaccuauuccgaggcacccucgagccggucgagaaagcgcuccgagacgcaaaacucgacaaaggacaaauacaagaaauaguccucgucggaggcuccacccgaaucccuaaaauacaaaaacuacuccaagacuucuucaacggaaaagaacuaaacaaaucaaucaaccccgaugaagccguugcauacggcgccgcuguccaagcagcaauccuaauaggagauaaaagcgaaaacguacaagaccuccugcuacuagacgucaccccacucucacucggaaucgagaccgccggcgguguaaugaccccacucauaaaacgaaacaccaccauccccaccaaacaaacacagacguucaccaccuacuccgacaaccaaucauccgugcuagugcaagucuacgaaggcgaaagagccaugaccaaagacaacaaucuccucggcaaauucgaccugacgggcauacccccagccccacgaggcgucccccaaaucgaggucaccuucgacauagacgcgaacggcauccucaacgucacugcugcagacaaaucgacaggaaaggaaaacaaaaucaccaucacaaacgacaaggggcgccucagcaaagacgacaucgaccgaaugguacaagaagcagaacgcuacaagagcgaagacgaagccaacagagaccgcgucgccgccaaaaacgcccucgaauccuacacauacaacauaaaacaaaccgucgaagacgaaaaacuacgcggaaaaauaagcgagcaagacaaaaacaaaauauuagacaaaugccaagaaguaaucaacuggcucgaccgcaaccaaauggccgaaaaagacgaauacgaacacaaacaaaaagaacucgaacgaguaugcaacccgauaaucaguaagcuguaucaaggaggcccaggaggcggaagcggcggcggagguucgggcgcguccggaggcccaacaauagaagaagucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4596 - RNA, 2870 nt, Artificial Sequence
  mRNA product Design3 comprising derived and/or modified sequence from Homo sapiens__NP_002145.3 __HsHSPA4 (opt8)
gggagagucccgcagucggcguccagcggcucugcuuguucgugugugugucguugcaggccuuauucaagcuuaccaugagcgugguaggcauagaccugggcuuccagagcuguuaugucgcaguagcccgcgcaggcggcauagaaacaaucgcaaacgaguacagcgaccgcugcacaccggcaugcaucucguucggacccaaaaaccguagcaucggcgcggcagcgaaaagccaggucauaagcaaugcgaaaaacacaguccagggauucaaacgcuuccacggccgagcauucuccgacccauucgucgaagcagagaaaagcaaccuggcauacgacaucguccaguuaccgaccggccuaaccgggaucaaagucaccuacauggaagaggaacgcaacuucaccacagaacaagucaccgccaugcugcuaagcaaacugaaagagacugcagaguccguacucaagaaaccagugguggacugugucguaagcgugccgugcuucuacacggacgccgaacgacguagcgugauggacgcaacacaaauagcgggacugaacugucuccgccuaaugaaugaaacgacagcaguagcccucgcuuacggaauauacaaacaagaccuacccgcgcucgaagagaaaccccgcaacgucgucuucguggacaugggacacucggccuaccaagucuccgucugcgccuucaaccggggcaaacugaaaguccucgccaccgcauucgacaccacacuuggaggccgaaaauucgacgaaguucucgucaaccacuucugcgaagaguucgggaagaaauacaaacuugacauaaaauccaaaauccgagcacugcuccgacucagucaagaaugcgaaaaacuaaagaagcucauguccgcgaacgccagcgaccucccccuauccaucgaaugcuuuaugaacgacgucgacgucuccggaaccaugaaccgagggaaauuccuagaaaugugcaacgacuuacuagcgagaguagaaccaccccuacgaagcguacuagaacagaccaaauuaaagaaagaagauaucuacgcaguagaaauagugggcggagcaacccgcauacccgccguaaaagagaaaaucucaaaauucuuuggcaaagaacucucgacaacacuaaacgccgacgaagcagugacccgcgggugcgccuugcaaugcgcaauucucagccccgcuuucaaaguaagagaauuuucaauaacagacgucguaccauaccccauaucacuccgcuggaacuccccagcagaagaaggaagcuccgacugcgaagucuucuccaaaaaccacgcagcccccuucucuaaaguccucaccuucuaccggaaagaacccuucacccuagaagccuacuacucgucaccacaggaccuaccauaucccgaccccgcaaucgcgcaauucuccguccaaaaaguaacaccccagagcgacgggagcagcagcaaaguuaaaguaaaaguacguguaaacguacacggaaucuucucagucuccucagccucccucgucgaaguccacaaaagcgaagaaaacgaagaaccaauggaaaccgaccagaaugcaaaagaagaagagaaaaugcaagucgaccaagaagaaccccacgucgaggagcaacaacaacaaacuccagccgaaaacaaggccgaaucagaagaaauggagaccucacaagccgggucaaaagacaagaaaauggaucaaccgccccaagcgaagaaagcgaaagucaaaacauccacagucgaccuccccauagagaaccaacugcucuggcaaaucgaccgcgagaugcucaaccucuacaucgagaacgaaggaaaaaugaucaugcaggacaaacuagaaaaagaaaggaacgacgccaaaaacgccguggaagaguacgucuaugaaaugcgcgacaaauuaagcggagaguacgagaaauuugucuccgaagacgacagaaacuccuucacacuuaaacucgaagacaccgaaaacuggcuauacgaagacggcgaggaccagcccaaacaaguauacguggacaaacucgcagagcugaaaaaccuaggacaacccaucaaaauccgauuucaagaaagcgaagaacgccccaagcuguucgaggaacucggaaaacaaauccaacaauacaugaaaaucauaucauccuucaaaaacaaagaggaccaauacgaccaccucgacgccgcagauaugacgaaaguagaaaaguccaccaacgaagcgauggaauggaugaacaacaaacucaaccuacaaaacaaacaaucgcucacaauggaucccgugguaaagagcaaggagaucgaggcaaaaauuaaagaacucacauccacaugcagccccauaaucucaaaacccaaaccaaaggucgaaccgccaaaagaagaacagaagaacgccgagcaaaacggcccaguagacggccaaggcgacaacccaggcccccaagcagcggaacagggaaccgacacggccguccccucagauucggacaagaaacucccagaaauggacaucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4597 - RNA, 2867 nt, Artificial Sequence
  mRNA product Design3 comprising derived and/or modified sequence from Homo sapiens__NP_055093.2 __HsHSPA4L (opt8)
gggagagucccgcagucggcguccagcggcucugcuuguucgugugugugucguugcaggccuuauucaagcuuaccaugucaguggucggcaucgaccuaggcuuccucaacugcuacaucgccgucgcccgcuccggcgggauugaaacaaucgcaaacgaguacucggacaggugcacacccgcuugcauaucacugggaucgcggacgcgcgccauaggaaacgcagccaaaagccagaucguaacaaacgugcgcaacaccauccauggcuuuaaaaagcuccacggcaggagcuucgacgaccccaucguucaaaccgagcgcaucagacuaccauacgaauuacagaaaaugcccaacggcagcgccgggguaaaaguccgcuaccucgaagaagaacgaccuuucgcgaucgaacaaguuaccggaauguuacuagcaaaacugaaggaaaccucagagaacgcccucaagaaacccguggcagacugcguaauaucaaucccuagcuucuucacagacgcagaaagacguucaguaauggcggcagcccaaguagcagggcucaacugccuccgacuaaugaacgaaacaacagccguggcccucgccuacggcauauacaaacaagaccugccgccacuagacgaaaagccccgcaacgucguguucauagacaugggacacagcgccuaccaaguccucgucugcgccuuuaacaagggcaaacucaaaguccucgccacgacauucgaccccuaccugggcggacgcaauuucgacgaagcucucguagacuacuucugcgacgaguucaaaacaaaauacaaaaucaacgucaaggaaaacucaagagcccugcuccgacuauaucaagaaugcgagaaacuaaagaaacucauguccgcgaacgccagcgaccucccacuaaacaucgaauguuuuaugaacgaccuggacgucagcuccaaaaugaaccgcgcccaguucgaacaacucugcgccagccuacuagcacgcguggagccaccccucaaagccguaauggaacaagcgaaccuccagcgcgaggacauaucaagcaucgagauaguaggcggcgcgacgcgcauccccgccguaaaagagcaaaucacaaaauucuuccucaaagacauuucaacaacacuuaaugcagacgaagcaguagccaggggaugcgcucuacaaugcgccauccucagcccggcauucaaaguacgcgaguucuccaucacagaccuaguccccuacucaaucacacucagauggaaaaccucauucgaagacgggagcggagaaugcgaaguauucugcaaaaaccacccugccccauucagcaaagugauaacguuccacaagaaagaacccuucgaacuugaagcguucuacacaaaccuucacgaaguccccuacccugaugcgcgaaucgguucauucacaauacagaacguauucccccaaagcgacggcgacucgagcaaaguaaaagucaaaguccgcguaaacauccacggcaucuucucaguagcaagugccagcgugaucgaaaaacaaaaccucgaaggcgaccacagcgacgcccccauggagacagaaacaucguucaaaaacgaaaacaaagacaacauggacaaaaugcagguagaccaagaagaaggccaccagaagugccacgccgaacacacacccgaagaagaaaucgaccacaccggcgccaaaacaaaaucggcagucuccgacaaacaagaccggcuaaaccaaacccucaagaaaggcaaaguaaaaucaaucgaccuacccauacaguccucacucugccgccaacugggccaagaucuccuaaacucauacaucgaaaacgaaggaaaaaugauaaugcaagacaaacucgaaaaagaacggaacgacgccaaaaacgcgguagaggaguacgucuacgacuuucgggaccgacugggcacgguuuacgaaaaauucaucacacccgaagaccuaagcaagcuaucugcgguccuggaagauaccgagaacuggcucuacgaagacggcgaagaccaaccaaaacaaguguacguagacaagcugcaggaacugaagaaauaugggcaaccaauccaaaugaaauacauggaacacgaagaaaggcccaaagcacugaacgaccuaggcaagaaaauucaauuagucaugaaagugaucgaagcguacagaaacaaagacgaaagauacgaccaccucgacccuacagagauggagaaaguagagaagugcauaucagacgccauguccuggcuaaacagcaagaugaacgcccaaaacaaacucagccuuacgcaagaccccguggucaaagucucagaaauaguugcgaaaucaaaggagcuagauaacuucugcaaccccauaauauacaaaccgaagcccaaagccgaaguccccgaagacaagcccaaagccaacagugaacauaacgggccgauggacggacagucaggcacugagaccaaaagcgacucgacaaaagacagcagucaacacacaaagucguccggagagauggaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4598 - RNA, 2312 nt, Artificial Sequence
  mRNA product Design3 comprising derived and/or modified sequence from Homo sapiens__NP_005338.1__HsHSPA5 (opt8)
gggagagucccgcagucggcguccagcggcucugcuuguucgugugugugucguugcaggccuuauucaagcuuaccaugaaacucagccuagucgcagccaugcugcugcuccucagcgcagcacgggcagaagaggaagacaagaaagaagacgugggaacaguaguaggcauagaccucggaacgacauacagcugcguagggguauucaaaaacggacgagucgagaucauagccaacgaccagggcaacagaauaaccccaaguuacguagcguucacacccgagggugaacgacugaucggagacgcagcgaaaaaccaacucacaagcaaccccgaaaacacaguauucgacgcaaagcgacuaauaggccgcaccuggaacgaccccucgguccagcaagacaucaaauuccugccauucaaagucgucgagaagaaaacaaaacccuacauacaaguagacauagggggcgggcagacgaaaacguucgcgccagaagaaauaagcgcaaugguacugacgaaaaugaaagagaccgcagaagcguaccugggcaagaaagucacccacgcagucguaacagugccagccuacuucaaugacgcgcaacgacaagcaacaaaggacgcaggaacaaucgcgggacugaacgugaugcgaaucauaaaugaacccaccgccgccgcaauagcguacggacuagacaaacgggaaggcgagaaaaacauccuagucuucgaccugggcggagguaccuucgacguaagucuccugacaaucgacaacggcguauucgaagucguagcaacaaacggggacacacaccugggaggagaagacuucgaccagcgaguaauggagcacuucauaaaacuauacaagaagaaaaccggaaaagacguaaggaaagacaacagagccguacaaaaacucaggcgggaggucgaaaaagccaaacgcgcccuauccagccaacaccaagcgcgcaucgaaauagaaucauucuacgagggggaagacuucagcgaaacccuaacacgcgcaaaauucgaagaacugaacauggaccuauuccgcagcacgaugaaaccaguacaaaaaguccuagaggacagcgaccuaaagaaaagcgacauagacgaaauaguauuagugggcggcucgaccaggauaccaaaaauacaacaacugguaaaagaguucuucaacggcaaagaaccaucgcgagggaucaacccagacgaagccgucgcauacggagccgcaguucaagcaggaguacugagcggcgaccaagacacaggagaccucguacuacuggacgugugcccacucacccuaggcauagaaacaguaggcgggguaaugacaaaacucauaccaagaaacacggucgugcccaccaagaaaagccagauauucagcacggcaagcgacaaccaacccaccguaacgaucaaagucuaugaaggagaacgaccccucacaaaagauaaccaccuacugggcaccuucgaucuaacaggcauaccaccagccccaagagggguaccacaaauagaagugacauuugaaaucgacguaaacgggauucuccgagugaccgcggaagacaaaggaaccggaaacaaaaacaaaauaacgauaaccaacgaccaaaacagacucacaccggaagaaaucgaaagaauggucaacgacgcagagaaauuugccgaagaggacaagaaauugaaagagcgaauagacaccagaaacgaacucgaaagcuacgccuacucacucaaaaaccagauaggugacaaagaaaaacuaggagggaaacuaagcagugaagacaaagaaaccauggaaaaagccgucgaagagaaaaucgaauggcuagaaucacaccaagacgcagacauagaagacuucaaagccaaaaagaaagaacuagaagaaauaguacaaccaaucauauccaaacuauacggaagcgcagggcccccacccacaggagaagaggacacagcggaaaaagacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4599 - RNA, 2279 nt, Artificial Sequence
  mRNA product Design3 comprising derived and/or modified sequence from Homo sapiens__NP_002146.2__HsHSPA6 (opt8)
gggagagucccgcagucggcguccagcggcucugcuuguucgugugugugucguugcaggccuuauucaagcuuaccaugcaagcaccccgggagcucgcagucggcauugaucucggaacaacauacuccugcguaggaguguuccagcaagggcgcguggaaauacucgcaaacgaccaaggcaaccggaccaccccaagcuacguggccuucaccgacacagagcggcugguaggagacgcagcaaaaagccaagccgcgcugaauccccacaacacagucuucgacgcaaaaaggcuaauuggaagaaaauucgcagacacaacaguacaaagcgacaugaaacauuggcccuuccgagucgucucagaagggggcaaacccaaggucagagucugcuacagaggugaagacaaaacauucuaccccgaagagauaucaagcauggugcucagcaaaaugaaagagacggccgaggcauaccucgggcaaccggucaaacacgcgguaauaacagucccagcauacuucaacgauagccaacgccaagccacaaaagacgccggagcaaucgccgggcucaacguccuacgaauaaucaacgaaccaacagcggcagcaaucgcuuacgggcuagacagaagaggcgcaggcgaacggaacguccugauauucgaccuaggaggaggaacauucgacguaucagugcuaagcaucgacgcaggaguauucgaagucaaagccacggcaggagacacacaccugggcggggaagacuucgacaacaggcuaguaaaccacuucauggaagaguuccggcgcaaacacgggaaagaccuaucagggaacaaaagagcccugcgaaggcugagaacagccugcgaacgcgcaaaaaggacacuaagcagcuccacacaagcaacacuagaaauagacucccucuucgaaggagucgacuucuauaccucgaucacgcgcgcacgauucgaagaacuaugcagcgaccucuuccgaucgacccuggaaccgguagaaaaagcccuaagagacgcgaagcuagacaaggcccaaauacacgacguaguccucguaggaggaucgacacgcaucccaaaaguacaaaaacuccuacaagacuucuucaacgggaaagaacucaacaagucaauaaaccccgacgaagcaguggccuacggugccgcaguucaggccgcaguccugaugggcgacaagugcgaaaagguucaagaccuacuacuccuagacguggcaccccucucccucggacuagagacagcgggcggagucaugacuacacuaauccaaagaaacgcaaccaucccaacaaagcaaacacaaacauucacaaccuacucagacaaccaaccaggcguauucauccaagucuacgagggcgaacgcgcaaugaccaaagauaacaaccuacugggccgauucgagcucucaggcauacccccagcaccccgaggagucccacaaauagaaguuacauucgacaucgacgccaacgggauauugagcgugaccgcaacagaccgcucaaccggaaaggcaaacaaaauaacaauaacaaacgauaaaggacgacuaagcaaagaagaaguggagcgcaugguacacgaggcggaacaauacaaggccgaggacgaagcccaacgggacagaguagccgccaaaaacagccuggaagcgcacgucuuccacgucaaaggaucacuacaggaagaaucccuccgagacaaaauacccgaggaagacagacgaaaaaugcaagacaagugccgagaaguccuagccuggcucgaacacaaccaacuggccgaaaaagaagaauacgaacaccaaaagcgagaacuagagcaaauaugcagaccaauauucucgagacuauacggcgggccgggcguaccuggcggaucgagcugcggcacccaagcccgacaaggcgacccaucaaccgggccuauaaucgaggaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4600 - RNA, 1451 nt, Artificial Sequence
  mRNA product Design3 comprising derived and/or modified sequence from Homo sapiens__P48741__HsHSPA7 (opt8)
gggagagucccgcagucggcguccagcggcucugcuuguucgugugugugucguugcaggccuuauucaagcuuaccaugcaagcaccacgcgaacucgcagucggaaucgaccuaggcaccacauacucaugcgucggcguauuccaacaaggaagagucgaaauccucgccaacgaccaaggaaaccgaaccacgccaagcuacgucgcauucacagacacagaacgccuggucggcgacgcagccaaaagccaagccgcacucaacccacacaacacaguauucgacgcaaaacggcucauaggccgcaaauucgccgacaccaccguccaaagcgacaugaaacauuggccauuccaagucguaagcgaaggcggcaaacccaaaguccgagucugcuacagaggcgaggacaaaacauucuacccagaagaaaucuccagcaugguacuaaguaaaaugaaagaaaccgcagaagcauaccuaggccaacccguaaaacacgcaguaauaaccguaccaaccuacuucucaaacagccaacgccaagcaacaaaagacgcaggagccaucgccggccucaaaguccucccaauaauaaacgaagcaaccgcagccgcaaucgccuacggacucgaccgacgaggcgccggcaaacgaaacguacucauauucgaccucggcggcggcaccuucgacguaagcguacuaagcaucgacgcaggagucuucgaagucaaagcaacggccggcgacacacaccuuggaggagaagacuucgacaacagguuagucaaccacuucauggaagaguuccgccgcaaacacggaaaagaccucucaggaaacaaacgcgcacugcgacggcuacgaacagcgugcgaacgcgcaaaacgcacccccuccagcagcacacaagccacucucgaaaucgacucacuguucgaaggcgucgacuucuacaaauccauaacacgcgcacgcuucgaagaacucugcagcgaccucuuccgcagcacccucgaacccguugaaaaagcccuacgcgacgccaaacuagacaaagcccaaauccacgacuucguccugggcggcggccuccacucacacccccaaggagccgaaguagcagcaggacuccugcaacgccaaggagcagaacaagaacaccaacccuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4601 - RNA, 2288 nt, Artificial Sequence
  mRNA product Design3 comprising derived and/or modified sequence from Homo sapiens__NP_006588.1 __HsHSPA8 (opt8)
gggagagucccgcagucggcguccagcggcucugcuuguucgugugugugucguugcaggccuuauucaagcuuaccaugagcaaaggaccagcaguagggauagaccucggaaccacauacuccugcguagggguauuccagcacggcaaaguagaaauaauagcgaacgaccaaggcaaccggaccaccccuuccuacguagccuucaccgacacagagcgccucaucggagacgcggccaaaaaccaagucgcaaugaaccccaccaacacaguauucgacgcaaaaagacucauaggcaggcgguucgacgacgcagucguacaaagcgacaugaagcacuggcccuucauggucguaaacgacgcaggacgcccaaaaguccaaguagaauacaagggcgagacaaaauccuucuacccagaagaggucuccagcaugguacugaccaaaaugaaagagauagcagaagccuaccucggaaaaacuguaaccaacgcaguagucacagucccagccuacuucaaugacagccaacgccaggccaccaaagacgccggaaccaucgccggacuuaacguacuacgcaucaucaaugagccaacggcggccgcaaucgcguacgggcucgacaaaaagguaggagccgaaagaaacguccugaucuucgaccuaggaggaggaacauucgacgucucaauccucacaauagaagacggcauauucgaaguaaagagcacggccggcgacacacaccugggaggagaagacuuugacaacagaaugguaaaccacuucauagcagaguucaagcgcaagcacaagaaggacaucagcgaaaacaaaagagcaguacgccgccuccgcaccgccugugaaagagcaaaacgcacccucagcuccagcacccaagcaaguauagaaauugacucacuauacgaaggcaucgacuucuacaccagcaucacccgagcaagauucgaagaauuaaacgcagaccucuucagaggaacccuggacccagucgagaaagcacuacgagacgcaaaacuagacaaaagucaaauacacgacauaguccuagucggaggcagcacacgaaucccgaagauacagaaacuccuccaagacuucuucaacggaaaagaacuaaacaaaagcauaaauccagacgaagcagucgcauacggcgcagcgguccaagcggccauacuuucaggcgacaaaagcgagaacguacaagaccugcugcuccuggacgucacgccgcucucacuaggcaucgaaacagccggcggcguaaugaccgugcucauaaaacgcaacacaaccauaccaacaaaacagacccagaccuucacgacauacuccgacaaccagccaggcguacucauacaggucuacgaaggagaacgcgcaaugacaaaagacaacaaccuccuaggcaaauucgaacucacagggauacccccagcaccgcgcggagucccacaaauagaagucaccuucgacaucgacgcaaacggaauccuaaacguauccgccguagacaaaucaaccggaaaagaaaacaaaauaacgaucacaaacgacaaaggccgccuaagcaaggaggacaucgagagaaugguccaggaggccgaaaaauacaaagccgaagacgaaaaacaacgcgacaaaguaaguagcaagaacagccuggaaagcuacgcauucaacaugaaggcgacggucgaagacgaaaaacugcagggaaaaauaaacgacgaagacaaacagaaaauccuagacaaaugcaacgaaaucauaaacuggcuggacaaaaaucaaaccgccgaaaaagaagaauuugaacaccaacaaaaggagcucgaaaaagugugcaaucccauaaucaccaaacuauaccaaucagcgggaggaaugcccggagggaugccgggcggguucccaggagggggagcacccccaagcggaggcgcaagcucgggccccacgauagaggaggucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4602 - RNA, 2387 nt, Artificial Sequence
  mRNA product Design3 comprising derived and/or modified sequence from Homo sapiens__NP_004125.3 __HsHSPA9 (opt8)
gggagagucccgcagucggcguccagcggcucugcuuguucgugugugugucguugcaggccuuauucaagcuuaccaugauaucagccagccgcgcggccgccgcaagacuggugggagcagccgcgagccgcggaccaacagcagcgcggcaccaagacagcuggaacggacugucacacgaagcauuccgacucgugaguagaagagacuacgcgagcgaagccauaaaaggggccguagucggaaucgaccucggaacaacaaauaguugcguagccgugauggagggaaaacaagccaaaguacuagagaacgcggagggagcgagaaccacaccaagcgucguagccuucaccgcagauggagaaaggcucguaggcaugcccgcaaaaagacaagcagugacgaacccaaacaacaccuucuacgcgacaaagcgccucaucggccgacgcuacgacgaccccgaggugcaaaaagacaucaaaaacguaccauucaaaauagugagagcaagcaacggcgacgccugggucgaagcccacggcaaacuauauagccccagccagauaggggccuucgucuugaugaaaaugaaagagaccgcagaaaacuaccuaggacacacagccaagaacgcaguaauaaccguaccugcauacuucaacgacagccagagacaagccacaaaggacgccggccagauaagcggacuuaauguacuacgcguaauaaacgaaccgacagccgccgcgcucgcauacggccuagacaaaagcgaggacaaaguaauagcaguauacgaccuaggagggggaacuuucgacaucucgauacuagaaauacaaaagggaguuuucgaggucaagucaacaaacggggacaccuucuuaggcggagaagacuucgaccaagcgcugcuacgccacaucgugaaagaguucaaaagagaaacaggggucgaccucacgaaagacaacauggcacuccaaagagucagagaagcggcagaaaaagcgaaaugcgaacuaagcagcagcguccaaacagacauaaaccuacccuaccuaacaauggauagcucaggcccaaaacaccugaacaugaagcucacgcgcgcgcaauucgaggggauagugacugaccucaucagaagaaccauagcaccaugccaaaaagcaaugcaagaugccgaaguaagcaaaagcgacauaggggaagucauccuagucggaggaaugacgaggaugccaaaaguacaacaaacaguacaagaccucuucgggagagccccguccaaggccguaaacccggacgaggcaguagccauaggagcggccauacaaggaggaguccuagccggggacguaacagacgugcugcugcucgacguaacaccccugucucugggcauugaaacccuaggaggcguuuucacaaaacucaucaacagaaacacgacgauaccgacuaagaaaucccaagucuucuccacagccgccgacggucaaacccaaguagaaaucaaagucugccaaggagagagggaaauggccggggacaacaaauuacucgggcaauucacccucaucggaaucccacccgcgccccgaggcgugccccagauagaggucacauucgacaucgacgccaacggaauaguacacguaagcgccaaagacaaaggaacaggccgggaacaacagauagucauacagucaagcggaggccucagcaaggacgacaucgaaaacauggucaaaaacgcagagaaguacgcagaagaggaccggagaaagaaagaacgcguggaagcaguaaacauggccgaagggauaauacacgacaccgagacaaaaauggaggaguucaaagaccagcugcccgcggaugaauguaauaaacuaaaagaagaaauaagcaaaaugagggaacuacucgcacgaaaggacucugaaacgggcgagaacauuagacaagcggcaagcagccuccaacaagcaucccugaagcucuuugaaauggcauacaagaaaauggcgucggaaagggaaggguccgggagcucaggcacgggagagcaaaaggaagaccaaaaggaggaaaaacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4603 - RNA, 2375 nt, Artificial Sequence
  mRNA product Design3 comprising derived and/or modified sequence from Homo sapiens__NP_079291.2__HsHSPA12A (opt8)
gggagagucccgcagucggcguccagcggcucugcuuguucgugugugugucguugcaggccuuauucaagcuuaccauggcggacaaagaagccggaggaagcgacggcccccgcgaaaccgccccaacauccgccuacagcucgcccgcccgcagccuaggagacaccggaaucacaccccucucucccucccacauugucaacgacaccgacuccaacguaucugaacaacaaucauuccucguaguagucgcaguagacuucggcaccaccucguccggauacgcauacucguucaccaaagaacccgaauguauccacguaaugagacgcugggaaggcggcgaccccggggucuccaaccagaaaaccccaaccaccauacuacucaccccagaaagaaaauuccacuccuucggauacgccgcccgcgacuucuaccacgaccucgaccccaacgaagccaagcaauggcucuacuuggaaaaauucaaaaugaaacuccauacaaccggagaccucaccauggacaccgaccucacagcugcaaacggcaagaaagucaaagcacucgagaucuuugccuacgcgcugcaauacuucaaagaacaagcccucaaagaacucuccgaccaagcagggucagaguucgaaaauagcgacguccgaugggucaucaccgucccagcaauuuggaaacaacccgcaaaacaauucaugcgccaagccgccuaccaagcuggccuagcuucaccagaaaacucagaacaacuaaucauagcacucgaaccggaagcagcaagcaucuacugcagaaaacuacgccuccaccaaaugaucgaacucagcucaaaagccgccgugaacggcuacuccggauccgacaccguaggcgcgggcuucacacaagccaaagaacacauccgucggaaccgccaaucacgaacauuccuagucgaaaacgucauaggcgaaaucuggagcgaacuagaagaaggcgacaaauacgucguagucgacucaggcggaggcacaguggaccucaccguacaucaaauccgccuaccagaaggccaccucaaagaacucuacaaagcuacaggcggaccauacggaucacugggcgucgacuacgaguucgaaaaacuacuauacaagaucuucggcgaagacuuuaucgaacaauucaaaaucaaaagacccgccgccuggguagaccucaugaucgccuucgaauccagaaagagggcagccgcgcccgaccgcacuaacccccugaacauaacacucccauucagcuucaucgacuauuacaagaaauuccgcggccacucaguugaacacgcccuccgcaaauccaacguagacuuuguaaaauggucaucccaaggcaugcuccggaugucccccgacgccaugaacgcccuauucaaaccaaccauagauuccauaaucgaacaccucagagaccucuuccaaaaacccgaagucucaaccguaaaauuccuuuuccuagucgggggauucgccgaagcgcccuuacuacaacaagcggugcaagcugcauucggcgaucaaugccgaauaauaaucccccaagacguaggccuaaccauacugaaaggggcaguacucuucggccucgaccccgcaguaaucaaaguccgacgcuccccacuaaccuacggcguaggcguacucaacagauacguagaaggaaaacauccaccagagaaacuccugguuaaagacggaaccagauggugcaccgacguauucgacaaauucaucagcgccgaccaaucaguugcacucggcgaauuaguuaagcgaagcuacacccccgcgaaaccaucccaacucgucaucgucauaaauaucuacagcucagaacacgacaacgucucguucaucaccgaccccggggucaaaaagugcggcacgcucagacucgaccucaccggcaccagcgggacggcaguaccagcgcgacgcgagauacaaacccucaugcaauucggcgacacagagaucaaagccaccgcgauugacauagcaacaucaaaaucugucaaagucggaaucgacuucuuaaacuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4604 - RNA, 2408 nt, Artificial Sequence
  mRNA product Design3 comprising derived and/or modified sequence from Homo sapiens__NP_443202.3 __HsHSPA12B (opt8)
gggagagucccgcagucggcguccagcggcucugcuuguucgugugugugucguugcaggccuuauucaagcuuaccaugcucgccguccccgagaugggcuugcagggccuauacauaggcagcucacccgaaagaagcccagucccauccccaccuggaucccccagaacccaagaauccugcggaaucgcuccccucaccccaucacaauccccaaaaccggaaguccgcgcaccccaacaggccucauucucaguuguugucgccauagacuucggcacaaccucaagcggauacgccuucagcuucgccucagaccccgaagccauacauaugaugcgcaaaugggaggguggcgaccccggcgucgcccaccagaaaacgcccacuugccuacuccucaccccagaaggcgccuuccacuccuucggcuacacggccagagacuacuaccacgaccucgaccccgaagaagcaagggacugguuguacuucgaaaaauuuaaaaugaaaauucauagcgccacagaccuaacccuaaaaacgcaauuagaagcuguaaacggcaaaaccaugcccgcccucgaagucuucgcccacgcacuccgcuucuuccgagaacacgcacuccaagaacuaagagagcaaucacccagccuccccgagaaagacacaguacgcuggguacugaccguacccgccauauggaagcaaccagcgaaacaauucaugagagaggccgcauaccucgcagggcuaguaucccgggaaaacgcagaacaacuccucauagcauuagaaccagaagcagccucagucuauugcagaaaacuccgccugcaccaauugcucgaccucagcggccgcgccccaggaggcggucgacucggcgaacgacgaagcauagacucaucauuccgccaagccagagaacagcuccgccgauccagacacucacgaaccuuccuuguagaauccggcgucggagagcuuugggccgaaaugcaagccggggaccgauacgucguagccgacugcggcggcggaaccgucgaccuaacaguacaccaacuagaacaaccacaugguacccucaaagaacucuacaaagccuccggcggucccuacggagccguuggcguagaccucgcauucgaacaacuacucugcagaauauucggagaagacuuuauagcuaccuuuaaaagacaacgacccgcagccugggucgaccuaacuauagccuucgaagcacgcaaacgaacagccggcccacacagagccggcgcacucaacauaagccuaccauucucguucauagacuucuaccgcaagcaaagaggccacaacgucgaaaccgcccucagacgaucauccguaaacuucguaaaauggucaagucaaggaaugcugcgaaugucaugcgaagcaaugaacgagcuauuccaaccgacaguaagcggaaucauccaacacaucgaagcgcuccuagcgcgcccugaaguccaaggcguaaaacuucuauucuuaguuggaggauucgcagaaagcgccguacuucaacaugcaguccaagcagcacucggcgcacgcgggcuccgagucgucgucccccacgacguuggccuaaccauacucaaaggagccguccucuucggacaagccccaggggucguccgagugcgcagaucaccgcuaacauacggcguaggcgugcucaaucgcuucguaccaggcagacacccgcccgaaaaacuccuaguccgagacggacggcgcuggugcaccgacgucuucgaaagauucgucgcggcugaacaauccguagcccucggcgaagagguacgucgcagcuacugcccagcccgacccggacagagacgaguucucaucaaccucuacugcugugcagcagaagacgcccgguucauaacagaccccggcguaagaaaaugcggagcacucucccuugaacuagaaccggcagacugcggacaagacaccgccggcgccccacccggaagacgcgaaaucagagccgcaaugcaauucggagacacagaaaucaaagucacagcaguagacguaagcaccaacagaagcgucagagcaagcauagacuuccucucaaacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4605 - RNA, 1763 nt, Artificial Sequence
  mRNA product Design3 comprising derived and/or modified sequence from Homo sapiens__NP_008879.3__HsHSPA13 (opt8)
gggagagucccgcagucggcguccagcggcucugcuuguucgugugugugucguugcaggccuuauucaagcuuaccauggcccgcgaaaugaccauacuaggcuccgccguauuaacccuccuccuugcaggcuaccuagcacaacaauaccucccacuaccaaccccaaaagucauuggcauugaccucggaaccacguacugcagcgucggcgucuucuucccuggaaccggcaaagucaaaguaauacccgacgaaaacggccacaucuccauaccauccaugguuuccuucaccgacaacgacguguacgucggauacgaauccgucgaacucgccgacagcaacccacagaacaccaucuaugacgcaaaacgauucaucggaaaaauauucacagccgaagaacucgaagccgaaaucggacgcuauccauucaaaguacuaaacaaaaacggcaugguagaguucuccgucacaagcaacgaaaccaucaccgucagccccgaguacguaggaucuagacugcuucuaaaacuaaaagaaauggccgaagccuaucugggcaugcccgucgccaacgcaguaaucucgguccccgcagaguucgaccuaaaacaacgaaacucaaccauagaagcggccaaccuagccggccucaaaauacuaagagucauaaacgaacccacugccgcggcuauggccuacggucuccacaaagccgacgucuuccacguccucgucaucgaccucggcggcggaaccuuagacgucagccuacucaacaaacaaggcggcauguuccucacccgcgcaaugagcggcaacaacaaacucggaggccaagacuucaaccaacgccuacuccaauaccucuacaaacagaucuaccaaaccuacggcuuuguaccaucccgcaaagaagaaauacaccgacuccgacaagccgucgaaauggucaaacucaaccugacccuacaccaaagcgcccagcuaucuguacuacuaaccgucgaagaacaagaccgcaaagaaccccacucaagcgacaccgaacuccccaaggacaaacucagcucugcggacgaccaccgcgucaacuccggcuucggccgaggcuuaucagacaagaaauccggagaaagccaaguccucuucgaaaccgagauaucccgcaaacuauucgacacacucaacgaagaccuauuccagaaaaucuuaguacccauacaacaaguccucaaagaaggccaccuggagaaaacagaaauagacgaagucguccuaguaggcggcagcacacgcaucccccgcauuagacaagucauccaagaguucuucggcaaagaccccaacaccuccgucgaccccgaccuagccgucgugaccgggguagcaauccaagccggcaucgacggaggcuccuggccacuacaggucucggcacuugaaaucccgaacaaacaccuccagaaaaccaacuucaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4606 - RNA, 1877 nt, Artificial Sequence
  mRNA product Design3 comprising derived and/or modified sequence from Homo sapiens__NP_057383.2__HsHSPA14 (opt8)
gggagagucccgcagucggcguccagcggcucugcuuguucgugugugugucguugcaggccuuauucaagcuuaccauggcagcaaucggcguccaccucggaugcacaucagccugcgucgccgucuacaaagacgggcgcgccggcgucgucgcaaacgacgcgggcgaccgcgucacaccagccgucgucgcauacuccgaaaacgaagaaauaguaggccuagccgccaagcaaucccgcauacgcaacaucagcaacacagucaugaaaguaaaacaaauauuaggccgcuccuccuccgacccacaggcccaaaaauacaucgcagaaucaaaaugccucguaaucgagaaaaacggcaaacuacgcuacgagaucgacacuggcgaagaaaccaaguucguaaacccagaagacgucgcccgccuaaucuucucaaaaaugaaagaaacggcccacucaguccucggcuccgacgccaacgaugucgucauaaccguaccauucgacuucggcgaaaaacaaaagaacgcacuaggcgaagccgcccgcgcagcgggauucaacguccuacgccucauacacgaaccauccgcggcccucuuagcuuacggaaucggacaagacucccccaccggcaagucaaacauccuaguauucaaacuaggaggaaccucacuaucacucucagucauggagguaaacucaggcaucuaccgcguccucagcaccaacacagacgacaacaucggaggagcccacuucaccgaaacacucgcccaguaccucgccuccgaguuccagcgaucguucaaacaugacguacgaggaaacgcacgcgcaaugaugaagcucacgaacagcgcagaagucgcaaagcacucccuaagcacacuaggcagcgcaaacugcuuccuggacucauuauacgaaggacaggacuucgacugcaacguaagccgcgccagauucgaacuccucugcucaccccucuucaacaaaugcaucgaagccauacgcggacuacuagaccaaaacggguucaccgccgacgacaucaacaaagucguucucugcggcggauccagccgcauccccaaacugcaacaacucaucaaggaccuauuccccgccgucgagcugcuaaacuccauaccacccgacgaaguuauacccauuggagcagcaauagaggccggcauccucaucggcaaagagaaccuccucgucgaagacucccugaugaucgagugcuccgccagagacauacucgucaaaggcgucgacgaaucaggagcaucacgcuucacaguccuauuccccucuggaacaccccuuccagcacgacgacaacacacccuacaagcaccaggcagcauuuccuccgucugccuagaacucuacgaauccgauggcaaaaacucggccaaagaagaaaccaaguucgcacaagucguacuccaagaccucgacaagaaagaaaacggacuccgcgacauccuggccgugcucaccaugaagcgagauggaucacuacacgugaccugcaccgaccaggaaaccggcaaaugcgaagccaucagcaucgaaaucgcauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4607 - RNA, 2924 nt, Artificial Sequence
  mRNA product Design3 comprising derived and/or modified sequence from Homo sapiens__NP_006635.2 __HsHSPH1 (opt8)
gggagagucccgcagucggcguccagcggcucugcuuguucgugugugugucguugcaggccuuauucaagcuuaccauguccgucgucggacuggacgugggaagccaaagcugcuacauagcagucgcccgggcagggggcaucgaaacaaucgccaaugaguucagcgacagaugcacuccaagcgucaucuccuucggauccaaaaacagaacaauaggagucgccgccaaaaaccaacagauaacccacgcaaacaacaccgucucaaacuucaaacgguuccacggcagagcauucaacgaccccuucauacaaaaagaaaaagaaaaccuaucauacgaccucgucccacucaaaaacggaggagucgguaucaaagucauguacaugggcgaagaacaccuuuucucaguagagcaaauaacagcaaugcuacuaaccaaacucaaagagacagcagaaaacucgcugaagaaaccagucacagauugcgucauaagcgucccgagcuucuucaccgacgccgaacgacgcucaguacuagacgcagcccaaaucgucggccugaacugucucagacuaaugaacgauaugacggcagucgcccuaaacuacggcauauacaaacaggaccucccaucacuggaugaaaaaccacguaucguggucuucgucgacaugggccacucagcauuccaagucuccgcaugcgccuucaacaaaggcaaacucaaaguacuaggcacagccuucgacccauuccuugggggcaaaaacuucgacgaaaaacuggucgagcacuuuugcgcagaguucaaaaccaaauacaaacucgacgccaaaagcaaaauccgagcacuucuacgauuauaccaagaaugcgaaaaacucaagaaacucaugagcagcaacucgacagaccuccccuugaacaucgaaugcuucaugaaugacaaggacgugucagggaagaugaaccggucacaguucgaagaacugugcgccgaacuccugcagaaaaucgaagucccacuguacucccuacucgaacaaacccaccugaaagucgaagacgucucagcaguagaaaucgugggaggggcaacccgaauaccugccgucaaagaacguaucgcgaaauucuucggaaaagacaucaguacaacgcucaacgccgacgaagcagucgccagagggugcgcacuccaaugcgcgauccuaucccccgcguucaaaguacgcgaguucuccgugacugacgccgucccauucccaaucucacuaaucuggaaccacgacucagaagacacggaaggaguccacgaagucuucagccgcaaccacgcugcccccuucucuaaaguauuaaccuuccuccgccgagguccauucgaacucgaagcguucuacucagacccacaagggguacccuacccggaggcgaaaaucggccgcuuuguaguacaaaacgucucagcccagaaagacggcgaaaaaucccgggucaaagucaaaguccgcgucaacacccacggcauauucaccaucucaacugccagcauggucgagaaaguaccaacagaggagaacgaaaugucaagcgaagccgacauggaaugccuaaaucaaagaccgccagaaaacccugacaccgacaaaaacguacaacaagacaauuccgaagcagggacccagccacaaguccagacagacgcacaacagaccagccaaucacccccauccccagagcucacgagcgaagaaaacaaaauaccagacgcagacaaggcaaacgaaaagaaagucgaccagccgccagaagcgaaaaagccgaaaaucaaaguagucaacgucgaacuccccauagaagcaaaccucguauggcagcucgggaaagaccuccuaaacauguacaucgagacagaaggcaaaaugauaaugcaagacaaacuagaaaaagaaagaaacgacgcuaaaaacgcaguagaagaguacgucuacgaguuccgcgacaaacucugugggcccuacgaaaaauucaucugcgaacaagaccaccaaaacuuccuaagacuccuaaccgaaacggaagacuggcucuacgaagaaggcgaggaccaagcaaaacaagccuacgucgauaaacucgaggagcuaaugaaaaucggcacgcccgucaaaguccgcuuccaagaagcagaagaacgaccgaagauguucgaagaacugggccagcgcuugcaacacuacgcgaaaauagcggccgacuuccgcaacaaagacgaaaaauauaaccacauagacgaaucagagaugaaaaagguagagaaaagcguaaacgaaguaauggaauggaugaacaacgucaugaacgcccaagccaagaaaucacuagaccaagaccccguugucagagcccaagaaauaaaaaccaaaauuaaagaacucaacaacacaugcgagccagucgucacccaaccgaaaccaaaaauagaaucuccaaaacucgaaagaaccccaaacggcccuaacaucgauaagaaagaagaggaucucgaagacaaaaacaacuucggggcagaacccccgcaccaaaacggcgaaugcuaccccaacgagaaaaacucugugaacauggaccuagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4608 - RNA, 3347 nt, Artificial Sequence
  mRNA product Design3 comprising derived and/or modified sequence from Homo sapiens__NP_006380.1 __HsHYOU1 (opt8)
gggagagucccgcagucggcguccagcggcucugcuuguucgugugugugucguugcaggccuuauucaagcuuaccauggccgacaaaguccgacgacaacgaccgcgccgacgaguauguugggcgcucgucgccguacugcucgccgaccuacuggcccuaagugacacccucgcagugaugaguguagaccuaggcuccgaauccaugaaggucgcgauagucaaaccaggagugccgauggaaauaguccucaacaaggaauccaggcgaaaaaccccaguaauaguaacccucaaagaaaacgagcgguucuuuggagacucagcagcaagcauggcaaucaagaauccaaaagccacccuacgauacuuccaacaccuacuaggaaagcaggcagacaacccacacgucgcacuauaccaggccagguucccggaacacgagcugaccuucgacccccaaaggcaaacgguacacuuccaaaucagcagccaacuacaauucagcccagaagaaguccucggaaugguccuaaacuacagcagaagccucgcagaggauuucgccgaacagccaauaaaagacgccguaauaacagucccaguauucuucaaccaagccgagcgacgagccguccuacaggcagcacgcauggccgggcucaagguacuccagcuaauaaacgacaacacggcaacggcccuauccuacggagucuuucggagaaaagacauaaacacaaccgcacaaaacauaauguucuacgacaugggcucaggcucgacagucugcacaauagucacauaccagauggucaaaacaaaggaagccgggaugcaaccgcaacugcaaauacgaggagucggauucgaccgaacacugggaggacuagaaauggaacuacgacuccgagagaggcuggccggccuauucaacgaacaaagaaaaggccaacgcgcaaaagacguaagggaaaacccacgagcaauggcuaaacuacuccgagaagccaaccgacugaaaacaguacuaagcgcaaacgcagaccacauggcgcaaauugaagggcuaauggacgacguagacuucaaagcaaaagucacccgcguggaguucgaggaacucugcgcagaccuguuugaacgcguccccggccccguacaacaagcacugcaaagcgcagaaaugagccuagacgagauagaacaaguaauccuaguaggcggcgccacacgaguacccagaguucaagagguacuacugaaagcugucgggaaagaggaacuaggcaaaaacaucaacgccgacgaggccgcagcaaugggagccguauaucaagcagcagcauuaaguaaagcauucaagguaaagccguuuguaguacgggacgccgucguauacccaauuuuagucgaguucacgcgggaagucgaagaggaacccggaauacacucacugaaacacaacaaacgcguccuauucucacgaaugggucccuacccacaaagaaaaguaauaaccuucaaccgauacagccacgacuucaauuuccacaucaacuacggcgaccuuggauuccuagggcccgaagaccugagagucuucggaagccagaaccucaccacagucaaacugaaaggagugggggacagcuucaagaaauacccagacuaugaaucaaaaggaauaaaggcacacuucaaccucgaugaaagcggaguacugagccuggacaggguagaaagcguuuucgagacacugguggaagacagugccgaagaagagagcacacuaacaaaacugggcaacacaaucaguagccucuucgggggcggaacaacgccagacgcaaaagaaaacgggaccgacaccguacaagaagaagaagaaagcccagccgaaggaagcaaggacgagccaggagagcagguagagcucaaagaagaagcagaggcgcccguagaagacggcucucagccaccuccgcccgaacccaaaggagacgcaacaccagagggagagaaggcgaccgaaaaagaaaacggcgacaaaagcgaggcgcaaaaaccgucggagaaagccgaggcgggaccagaaggaguagccccagcacccgaaggcgaaaagaaacaaaaaccagcgagaaaaagaaggaugguggaggaaaucggcguggaacugguagugcuagauuuacccgaccucccagaagacaaacucgcgcagucgguacagaaauuacaagaccugacacuaagagaucuugaaaaacaagaacgagagaaggcggcaaacagucuggaagcguucaucuucgagacgcaggacaaacuauaccagccggaguaccaagagguaucaaccgaagaacaaagagaggaaaucuccggcaagcuaucggcggccucaacauggcucgaggaugaagggguaggcgccaccacagugaugcuaaaagaaaagcuagcugaacuaagaaaacuaugccaaggucuauuuuuccgagucgaggaaaggaagaaauggccagaaagacuaucggcccucgacaaccuacuaaaccacuccagcauguuucuaaaaggcgcgagacuaauaccagagauggaccaaaucuucacggaagucgaaaugaccacacuagaaaaagugauaaacgagacgugggcauggaaaaaugccacacucgcagaacaagccaaacuacccgcaacggaaaagcccguccuacucagcaaagacaucgaagcaaaaaugauggcguuagaccgcgaaguacaguaccuacuaaacaaagcgaaauucaccaaaccacgaccccgccccaaagacaaaaacggcacacgggcagagccaccacugaacgcaagcgccucagaccaaggggaaaaggucauacccccggccggacaaaccgaagacgcggaaccaauaagcgagcccgaaaagguggagacgggaagcgaacccggcgacacagagccacuggaacuaggaggcccgggcgcagaaccagagcaaaaggaacaaagcacagggcaaaagaggccacucaaaaacgaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4609 - RNA, 2546 nt, Artificial Sequence
  mRNA product Design3 comprising derived and/or modified sequence from Homo sapiens__NP_005339.3 __HsHSP90AA1 (opt8)
gggagagucccgcagucggcguccagcggcucugcuuguucgugugugugucguugcaggccuuauucaagcuuaccaugccagaagaaacgcaaacgcaagaccaaccaauggaagaggaggaaguagaaacguucgccuuccaggcagagaucgcccaacuaaugagccugauaauaaacacauucuacucgaacaaagagauauuccucagagagcucauaagcaacagcucggacgcacuggacaaaauacgauacgaaucccuaaccgacccgagcaaacucgacuccggcaaagaacuccacaucaaccuaauaccaaauaaacaggaccggacacucaccaucgucgacacagggauaggaaugacaaaagcggaccugaucaacaaccuaggaacgauugcaaaaagcggaacaaaagcguucauggaagcccuccaagcaggcgccgauauauccaugauaggacaauucggcgugggguucuacucagcauacuuagucgcggaaaaagucacgguaauaacgaaacacaacgacgacgaacaguacgcgugggagagcuccgcaggcggcagcuucacaguuaggacagacaccggagagcccauggggcgagggaccaaggucauccuucaccucaaagaagaccaaacggaauaccucgaagaaaggcgcauaaaggaaaucgugaagaaacacucccaauucauaggauacccuaucacacuauucguagaaaaagaacgcgacaaagagguaagcgacgacgaagcggaagagaaggaagacaaggaagaggaaaaagagaaggaagagaaagaaagcgaagacaagcccgaaauagaagacguaggcucggacgaggaagaagaaaagaaagacggcgacaaaaagaagaaaaagaaaauaaaagaaaaauacauugaccaggaggaacucaacaaaacgaaaccgauauggaccaggaacccggacgacaucacaaacgaagaauacggggaguucuacaaaucgcucacaaacgacugggaagaccaccuagcggucaaacacuucaguguggagggacaacuagaguucagagcacuccuguucgucccaaggcgagccccauucgaccuauucgaaaaccgcaaaaagaaaaacaacauaaaacucuacgucagaagagucuuuauaauggacaacugcgaggaacuaauccccgaauaccuaaauuucauccgaggggucguggacucugaagaccucccacuaaacaucucaagagaaaugcugcagcaaaguaagauccuaaaagugauccgcaaaaaccuaguaaagaaaugccuggaacuguucacggaacuggcggaggauaaagaaaacuacaaaaaguucuacgaacaauucuccaagaacauuaaacuggggauccacgaagacucccaaaacagaaagaaacugagcgaacuccugcgauacuacaccagcgcguccggagacgagauggucagccuaaaggacuacugcaccagaaugaaagaaaaccaaaaacacaucuacuauauaacaggggaaaccaaggaccaagucgcaaacagcgccuuuguagagcgccugagaaaacacggacucgaagucauauacaugauagaaccaaucgacgaauacugcguacagcagcugaaggaguucgaaggaaaaacgcuaguaucgguaacgaaagagggacuagagcuacccgaagacgaggaagagaaaaagaaacaagaagaaaagaaaaccaaauucgagaaccucugcaaaauaaugaaagacauccuagaaaagaaaguagaaaaagucguagugucaaaccgccucgucacgagcccauguugcauagucacgucaaccuacggauggacagccaacauggagaggauaaugaaagcccaagcccuacgagacaacucaacaaugggauacauggccgccaagaaacaccuagaaauaaaccccgaccauucgauaauagagacucuccgacaaaaagccgaggccgacaagaacgacaagagcguaaaagaccugguaauccuccucuacgaaacggcccuccuaucaagcggguucagccuagaagacccacaaacccacgccaaccgcaucuacagaaugauaaaacuaggacucggaaucgacgaagacgacccgaccgcggacgacaccucagcagcgguaacagaggaaaugcccccacuagaaggggacgacgacacgagcagaauggaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4610 - RNA, 686 nt, Artificial Sequence
  mRNA product Design3 comprising derived and/or modified sequence from Homo sapiens__NG_005218__HsHSP90AA3P (opt8)
gggagagucccgcagucggcguccagcggcucugcuuguucgugugugugucguugcaggccuuauucaagcuuaccauggacuccucaaaacuagacuccggcaaaggacuccacaucaaccucguccccaacaaacaaaaccaaacacucaccauaguagacacacgcaucggcaugaccaaaacagaccucaucaacaaccucggcaccgucaccaaauccggaacaaaagccuucauggaagcacuccaagccgacgcagacaucuccaugaucggacacuucggcgucggcuucuacucagcauaccucgucgccaaaaaagucaccguaaucucaaaacacaacaacgacgaacaauacaccugggaauccuccgcaggcggcuccuucaccguacgaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4611 - RNA, 2522 nt, Artificial Sequence
  mRNA product Design3 comprising derived and/or modified sequence from Homo sapiens__NP_031381.2__HsHSP90AB1 (opt8)
gggagagucccgcagucggcguccagcggcucugcuuguucgugugugugucguugcaggccuuauucaagcuuaccaugcccgaagagguacaccauggugaagaggaagucgagaccuucgccuuccaagccgaaauagcacaauuaaugagccugauaaucaacaccuucuacucgaacaaagaaaucuuccugcgcgaacucaucucgaacgcaagcgacgcccuagacaagauaagauacgaaucacugacagaccccagcaagcuagacucagggaaggagcucaaaaucgacaucauuccaaacccccaagaacggacacuaacccugguggacacagggaucgggaugaccaaggccgaccugauaaacaaccucgggacaaucgccaaaagcggcaccaaagcguuuauggaggcccuacaagccggagccgacaucagcaugaucgggcaauucggcgucggauucuacagcgccuaucuaguagcggaaaaaguaguagugaucacaaaacacaacgacgacgaacaauacgccugggaaagcagugcaggaggcagcuucacggugcgagccgaucacggagaacccauaggacggggcaccaaggugauacugcaccucaaagaagaccaaaccgaauaccuggaagaacgacgaguaaaggaggucguaaagaagcacagccaauucauaggcuacccaauaaccuuguaccuagagaaagaacgggaaaaagagauaagugacgacgaagcugaagaagaaaaaggcgaaaaagaagaagaagacaaagacgacgaagaaaagcccaaaaucgaggacguaggcagcgacgaagaagacgacagcggaaaagacaagaaaaagaaaacaaagaaaauaaaagagaaguacaucgaccaagaagaacucaacaaaacgaagcccauauggacaagaaauccagacgauaucacgcaagaagaauacggagaguucuauaagagucuaaccaacgacugggaagaccaccuagcggucaaacacuucagcgucgaaggacagcuagaguuccgagcccugcuauucaucccccgaagggcacccuucgaccuauuugaaaacaaaaagaagaaaaacaacauuaaacucuacguacgccgcgucuucauaauggacagcugcgacgaacuaauaccagaauaccugaacuucauccgcggagucgucgacagcgaagaccuaccacugaacauaucacgagaaaugcugcaacaaagcaaaauccucaaagucauacgcaaaaacaucguaaagaaaugccuugaacuauuuucggaacuggcagaagacaaagaaaauuacaagaaauucuacgaagccuucagcaaaaaccucaaacugggaauccacgaagacuccacaaaccgaagaagacuaagcgaacuccuaagauaccacaccagucaaagcggcgacgaaaugacaagccucucagaauacgugucccgaaugaaagaaacccagaaaagcaucuacuacaucacgggcgaaagcaaagaacaaguagcaaacagugcuuucguagaacgggugagaaagcgaggauucgaagucguguauaugaccgaaccaaucgacgaauacugcguacaacaacuaaaagaguucgauggcaagucccucguaucagucacgaaagaaggccuagaacugccggaagacgaagaagagaaaaagaaaauggaagaaagcaaagcaaaauucgaaaaccugugcaaacucaugaaagaaauacucgacaagaaagucgaaaaaguaacaauaagcaaccggcuagugagcagcccaugcugcaucgucacaagcacauacggcuggacggcgaacauggaaagaauaaugaaagcacaagcccuacgagacaacagcacgaugggauacaugauggcaaagaagcaccuagaaaucaacccagaccacccaaucguggaaacacuccgacaaaaagccgaagcagacaagaacgacaaggccguaaaagaucuagugguacuacuguucgaaaccgcgcuacucagcucaggauucagccucgaggacccacaaacccacucgaacaggaucuacagaaugaucaaacuaggccugggaauagacgaagacgaagucgccgccgaagaacccaacgcggcagucccagacgaaaucccaccauuggagggagacgaagacgcaagcaggauggaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4612 - RNA, 2759 nt, Artificial Sequence
  mRNA product Design3 comprising derived and/or modified sequence from Homo sapiens__NP_003290.1__HsHSP90B1 (opt8)
gggagagucccgcagucggcguccagcggcucugcuuguucgugugugugucguugcaggccuuauucaagcuuaccaugagggcguuauggguccuagggcugugcugcguccuccugacguucggcagcgucagagcagacgacgaaguggacguagacggcaccguagaagaagaccugggaaaauccagagaggguagcagaaccgacgaugaagucgugcagcgagaggaagaagccauccaacucgacgggcugaacgcgucacagauacgggaacuacgagagaaaagcgaaaaauucgccuuccaagcagaagucaaccgaaugaugaaguuaaucauaaacucacuauacaaaaauaaagaaauauuccucagagaacugauaagcaacgcgagugacgcacuagacaaaaucagacucaucagccucaccgacgaaaacgcccuuagugggaacgaagaacuaacagucaaaaucaaaugcgacaaggaaaagaaccuacuacacguaacagacacggguguaggaaugacccgggaggaacucgucaaaaaccucggcaccauagcgaaaagcggaacaucagaguuccucaacaaaaugacagaggcccaggaagacggacaaagcaccagcgaacugaucgggcaauucggaguaggauucuacagcgcguuccucguggcagauaaggucaucgucaccucaaaacacaacaacgacacccagcacauaugggagagcgacagcaacgaguucuccguaaucgcggacccccgcgggaacacgcucggccgcggaaccacaaucacacucguacucaaagaagaagcaagcgacuaccuagagcucgauacaauaaagaaccuggugaaaaaguacagccaguucaucaacuucccaaucuacguauggagcagcaaaacugagacgguagaagaaccaauggaagaagaggaagcagccaaagaagaaaaagaagagucggacgacgaggcagcgguagaagaagaagaagaagagaagaaaccgaaaaccaagaaaguagagaaaacgguaugggauugggaacuaaugaacgacaucaaacccauauggcagcgccccagcaaagaagucgaagaagacgaauacaaggcauucuacaagagcuucagcaaagaaagugacgacccgauggccuacauacacuucaccgcagaaggggaaguaacauucaagagcauacuauucgucccaaccucagcgccgcgaggacucuucgacgaguacgggagcaagaaaagcgacuacaucaaacuguacguaagacgcguauucauaaccgacgacuuccacgacaugaugcccaaauaccuaaacuuugugaaagggguaguagacagcgacgaccuaccccuaaacguguccagagaaacccuccagcagcacaaacuccugaagguaauaaggaagaaacuggugcggaaaacacuagacaugauaaagaaaauagccgacgacaaguacaacgacaccuucuggaaggaguucggcaccaacauaaaacuaggggugaucgaagaccauagcaaccggacccgacucgcaaaacuccuaagauuccaaucaagccaccaccccaccgacauaacgagccucgaccaguacguggaaaggaugaaggaaaagcaagauaaaaucuacuuuauggcgggcuccucccgaaaagaagcagaaagcucacccuucguagagcgacuacucaagaaaggguacgaaguuauauaccugacagaaccuguggacgaauacugcauacaagcacugccggaguucgauggcaaacgcuuccaaaacguggcaaaagaaggcguaaaauucgacgaaagcgagaaaacgaaagaaucacgcgaagcaguagaaaaagaguucgaaccccuacucaauuggaugaaagacaaagcauuaaaagacaaaauagaaaaagcaguagugagccaacgcuugaccgaaagcccgugugcccucguagcaagccaguacggcuggagcgggaacauggagagaaucaugaaagcgcaggcguaccaaacaggaaaagacauauccaccaacuacuacgcuucacaaaagaaaaccuucgaaauaaacccaagacauccgcuaauccgcgacaugcugcgacgaauaaaggaggacgaagacgacaagacaguacucgaccucgcagucguccucuucgaaaccgcaacgcuacggucaggcuaccugcucccagacacgaaagcauacggagacaggauagagaggaugcucagacuaagccuaaacauagacccggacgccaagguagaagaagaaccagaggaagaaccggaagaaacggcagaagacaccacagaggacacagagcaagacgaggacgaggaaauggacguaggaacugaugaagaagaagaaacggccaaagaaucgacagcagaaaaggacgaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4613 - RNA, 2462 nt, Artificial Sequence
  mRNA product Design3 comprising derived and/or modified sequence from Homo sapiens__NP_057376.2__HsTRAP1 (opt8)
gggagagucccgcagucggcguccagcggcucugcuuguucgugugugugucguugcaggccuuauucaagcuuaccauggcacgagaacuaagggcccuccuccuuuggggccgacgccuccgcccgcuacuucgcgcgccagcacuggcagcugucccaggaggcaaacccauccuaugcccccgccgaacaaccgcacagcucggucccagacgcaacccagcuuggucccuucaagcaggccgccucuucuccacucaaacagcagaagacaaagaagaaccacuccacagcauaaucucaucaaccgaaucaguacaaggcucaacaucuaaacacgaguuccaagccgaaacuaagaaacugcucgacauaguggccagaucccuauacuccgaaaaagaagucuucauccgcgaauugaucucaaacgcauccgacgcacucgaaaaacuacgacacaaacucgucuccgacggccaagcccucccagaaauggaaauccaucugcaaacuaacgccgaaaaaggcaccauaacaauccaggacacaggcaucggcaugacccaagaggaacuugucuccaaccucggaacaaucgcccgcagcggauccaaagcauuccucgacgcccuacaaaaccaagcagaagcaagcuccaaaaucaucggacaauucggagucggcuucuacucagccuucauggucgccgaccgcgucgaaguguacucacgcucagcugcacccggaagucuaggcuaucaauggcuaucagacggaagcggggucuucgaaaucgcagaagccucuggcgugcgcacaggcaccaaaaucaucauccaccugaaauccgacugcaaagaguucucgagcgaagcacgagucagggacguuguaaccaaauacucaaacuucguauccuuuccacuauaccucaauggccgucgaaugaacacccuccaagcaaucuggaugauggacccuaaagacguaagagaauggcaacacgaagaguucuaccgcuacguugcccaagcucacgacaaaccacguuacacccugcacuacaaaaccgacgcaccccugaauauccgaagcauuuucuacguccccgacaugaaacccucuauguucgacguaucccgcgaacucggcuccucagucgcccuauacucccgcaaaguccuuauacaaaccaaagccaccgacauacucccaaaauggcuccgcuuuauacgaggagucgucgacucagaagacaucccgcucaaccugagccgagaacuacuccaagaauccgcccucauucgcaaacugcgugacguccuccaacaacgccucaucaaauucuucaucgaccaaucaaagaaagacgccgaaaaauacgcuaaauucuucgaagacuacggccuauucaugcgcgaaggaaucgugaccgccacagaacaagaggucaaagaagacauagccaaacuccuaagauacgaauccuccgcacugcccucgggacaauuaaccucacuauccgaauacgcaagccguaugcgcgccgggacccgcaacaucuacuaccucugcgcccccaaccgacaccuggcagagcacuccccauacuacgaggcaaugaaaaagaaagacaccgaaguccuuuucugcuucgaacaauucgacgaacuaacccucuuacaccuaagggaguucgacaaaaagaaacucaucucaguggaaacggacaucguagucgaccacuacaaagaagaaaaauucgaagaccgcucaccagccgcagaaugucuauccgaaaaagaaacagaagaacucauggccuggaugcgcaacguccuaggcagucgcgucacaaacgucaaaguaacccuuagacuugacacccaucccgccaugguaacaguccucgaaaugggagccgcacgccacuuccuaagaaugcagcaacuagccaaaacacaagaagaaagagcccaacuccuacaaccuacacuagaaaucaacccccgccacgcacucaucaagaaacuaaaccaacuacgcgcaagcgaaccaggccuagcgcaacuccuaguagaccaaaucuacgaaaacgccaugauagcagcaggccuaguagacgacccccgcgccauggucggccgccucaacgaacuccuaguaaaagcccucgaaagacacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4614 - RNA, 809 nt, Artificial Sequence
  mRNA product Design3 comprising derived and/or modified sequence from Homo sapiens__NP_000609.1__HsIGF1 (opt8)
gggagagucccgcagucggcguccagcggcucugcuuguucgugugugugucguugcaggccuuauucaagcuuaccaugggcaaaaucuccucacuccccacacaacuauucaaaugcugcuucugcgacuuccucaaagucaaaaugcacacaauguccuccucacaccucuucuaccuagcccucugccuacucaccuucacaucaucagccacagccggcccugaaaccuuaugcggagccgaacucguagacgcccuccaauucgucugcggagaccgaggcuucuacuucaacaaacccaccgguuacggaucaucaucccgccgcgccccacaaacaggcaucgucgacgaaugcugcuuccgcucaugcgaccuccgaagacuagaaauguacugcgcaccccucaaacccgccaaauccgcccgcuccguccgagcccaacgccacacagacaugcccaaaacacaaaaagaaguccaccucaaaaacgccucccgaggauccgccggcaacaaaaacuaccgcauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4615 - RNA, 890 nt, Artificial Sequence
  mRNA product Design3 comprising derived and/or modified sequence from Homo sapiens__NP_000603.1__HsIGF2 (opt8)
gggagagucccgcagucggcguccagcggcucugcuuguucgugugugugucguugcaggccuuauucaagcuuaccaugggcauaccaaugggcaaauccaugcuaguacuccuaaccuuccuugccuucgcauccugcugcauagccgccuaccgacccuccgaaacacucugcggcggcgaauuagucgacacccuacaauucgucugcggcgaccgcggcuucuacuucucccgaccagccucccgcgucuccagacgcucacgcggcaucguagaagaaugcugcuuccgaucaugcgaccucgcccuccucgaaaccuacugcgccacccccgcaaaaucagaacgagacgucucaaccccacccaccguccuccccgacaacuuccccagauaccccguaggcaaauucuuccaauacgacaccuggaaacaauccacccaaagacuuagacgcggccuccccgcccuacuccgagcccgccgcggacacguacucgccaaagaacucgaagccuuccgcgaagccaaacgccaccgcccacucaucgcccuacccacacaagaccccgcccacggcggcgcacccccagaaauggccucaaaccgaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4616 - RNA, 986 nt, Artificial Sequence
  mRNA product Design3 comprising derived and/or modified sequence from Homo sapiens__NP_000591.1__HsIL6 (opt8)
gggagagucccgcagucggcguccagcggcucugcuuguucgugugugugucguugcaggccuuauucaagcuuaccaugaacuccuucuccacaucagccuucggccccgucgccuucucccucggacuccuccuuguccucccagccgccuuccccgccccagucccccccggcgaagacucaaaagacguagccgccccccaccgacaaccccuuaccuccuccgaacgcaucgacaaacaaauacgauacauccuagacggcaucucagcccuccgcaaagaaaccugcaacaaauccaacaugugcgaaucuuccaaagaagcccuagccgaaaacaaccucaaccuccccaaaauggccgaaaaagacggcugcuuccaaucaggauucaacgaagaaaccugccuugucaaaaucaucaccggccuccucgaauucgaagucuaccucgaauaccuccaaaaccgcuucgaaucauccgaagaacaagcccgcgccguccaaaugucaacaaaaguccucauacaauuccuccaaaaaaaagccaaaaaccucgacgccauaaccacccccgaccccaccaccaacgccucacuacuaaccaaacuccaagcccaaaaccaauggcuacaagacaugaccacccaccucauccuccgcuccuucaaagaauuccuacaaagcucccuccgcgcccuacgccaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4617 - RNA, 1628 nt, Artificial Sequence
  mRNA product Design3 comprising derived and/or modified sequence from Homo sapiens__NP_002183.1__HsINHBA (opt8)
gggagagucccgcagucggcguccagcggcucugcuuguucgugugugugucguugcaggccuuauucaagcuuaccaugccacuacuauggcuccgcggcuuccuacuggccucaugcuggaucaucguacgcagcagccccacaccaggaagcgagggacacagcgcagccccagacugcccaagcugcgcccuagcggcccugccaaaagacguacccaacagccaacccgaaaugguagaagccgucaaaaaacacauacuaaacaugcuacaccuaaaaaaaaggccagacguaacacaacccgucccaaaagcagcacuacucaacgcaauccgcaaacuccacgucgggaaagucggagaaaacggauacguagagauagaagacgacaucgggcgccgcgccgaaaugaacgaacucauggaacaaaccucagagauaaucacguucgccgaaagcggaacagcccgcaaaacacuacacuucgaaauaagcaaagaaggcagcgaccuaagcgucgucgagcgcgcagaagucuggcucuuccucaaaguacccaaagcaaaccgcacacgaacaaaagucacaauacgacuguuccagcaacaaaagcacccacaaggcucccucgacacaggcgaagaagcagaagaaguaggccuaaaaggagaacggagcgaacuacuccuaucagaaaaagucguagacgcacgcaaaagcacguggcacgucuucccaguaagcagcagcauacaacgacuacucgaccaaggcaaaagcagccucgacgucagaauagcaugcgaacaaugccaagaaucaggcgccucccucguccuacugggaaaaaaaaagaaaaaagaagaagaaggcgaaggaaagaaaaaaggcgguggagaaggaggcgcaggagcggacgaggaaaaagaacaaucccaccgcccauuucuaaugcugcaagcacggcaaucagaagaccacccccaccgccgccgacgacgaggacuagaaugcgacggaaaagucaacaucugcugcaaaaaacaauucuucgucagcuucaaagacauaggauggaacgacuggauaauagcgccaagcggauaccacgcaaacuacugcgaaggcgaaugccccagccacauagcaggcacaagcgggagcagccugucguuccacagcaccgugaucaaccacuacagaaugagaggacacuccccauucgcaaaccugaaaucgugcugcguccccaccaaacuacgaccgaugagcaugcucuacuacgacgacggacagaacaucauaaaaaaagacauacaaaauaugaucguggaagagugcggaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4618 - RNA, 1571 nt, Artificial Sequence
  mRNA product Design3 comprising derived and/or modified sequence from Homo sapiens__NP_002184.2__HsINHBB (opt8)
gggagagucccgcagucggcguccagcggcucugcuuguucgugugugugucguugcaggccuuauucaagcuuaccauggacggccugccaggccgagcguuaggcgccgccugccuccuacuccuagcagcaggcuggcucggccccgaagccuggggaucaccaaccccaccaccaacccccgcagccccucccccacccccaccacccggcagucccggcggaucacaagauaccugcaccucaugcggcggauuccgcagaccagaagaacucggacgcguagacggagacuuccucgaagccguaaaaagacacauacuaucccgccuccaaaugcgcggccgacccaacaucacacacgccguccccaaagccgccauggucaccgcccuacgcaaacuacacgccggcaaaguucgcgaggacggccgagucgaaaucccacaccucgacggccacgccucccccggcgcagacggacaagaacgaguuagcgaaaucaucuccuuugccgaaacagacggccuagccucaucacgaguccgacucuacuuuuucaucuccaacgaaggaaaccaaaaccucuucgucguacaagcaucccuauggcuauaccuaaaacuccuacccuacgucuuagaaaaaggaucccgccgcaaaguccgcgucaaagucuacuuccaagaacagggccacggcgaccgcuggaacauggucgaaaaacgcguagaccucaaacgcuccggcuggcacaccuucccccuaaccgaagccauccaagcccucuucgaacgcggcgaacgacgccuaaaccucgacguacagugcgacucaugccaagaacucgccguaguacccguauucgucgacccaggggaagaaagccacagaccauucgucgucguccaagccagacucggcgacucccgacaccgcauacgcaaacgaggccucgaaugcgacggccgcacaaaccucuguugccgccaacaauucuucaucgacuuccgccuaaucgguuggaacgacuggauuauagccccaacaggauacuacggcaacuacugcgaagggucaugccccgccuaccuagccggaguccccggcucugccagcucauuccacacagcagucgugaaccaauaccgcaugcgaggccuaaaccccggcaccguaaacucuugcugcauccccacaaaauuaucaaccauguccaugcuuuacuucgacgacgaauacaacauagucaaacgcgacguccccaacaugauaguagaagaaugcggcugcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4619 - RNA, 3806 nt, Artificial Sequence
  mRNA product Design3 comprising derived and/or modified sequence from Homo sapiens__NP_000623.2__HsITGAM (opt8)
gggagagucccgcagucggcguccagcggcucugcuuguucgugugugugucguugcaggccuuauucaagcuuaccauggcacuucgcguccuccuccuuaccgcccuaacccuaugucauggauucaaccucgacaccgaaaaugccaugaccuuucaagaaaacgcccgcggauucggccagucuguaguacagcuccaaggaucuagaguagucgucggugccccucaagaaaucguagcagcaaaccaacgcgguagucuauaccaaugugacuacucuacuggcucgugcgaaccuaucaggcuccaaguccccguggaagccgucaacauguccuuaggacuaucacuggccgccaccaccuccccaccgcaacuccuagccugcggacccaccguacaccaaacauguagcgaaaacacguacgucaaaggacucuguuuucucuucggcagcaaccuacgccaacaaccccaaaaauucccugaagcccucagaggcugcccacaagaagacuccgacauagccuuccucaucgacggauccggcuccauuauaccccacgacuuccggaggaugaaagaauuugucucgacgguaauggagcaacucaagaaaucaaaaacacuguucagccuaaugcaauacucggaggaguuccgaauccacuucaccuucaaagaguuccaaaacaaccccaacccccguagccuuguuaaacccauaacccaacuacugggccgaacacacaccgccaccggcauccgcaaagucguccgcgaacuauucaacauaaccaacggcgcacgcaaaaaugcuuucaagauacuuguaguaaucacagacggagaaaaauucggagacccauugggauacgaagacgucauuccugaagccgaccgagaaggcguaaucagauacgugauagguguaggcgacgcauucagaucagaaaaaucacgccaagaacuaaacacaauagccuccaagccaccccgagaccaugucuuccagguaaacaauuucgaggcacuuaaaacuauucagaaccagcuccgugagaaaaucuucgccaucgaaggaacucagacaggauccuccucgucuuucgaacaugagaugagccaagaaggcuucagcgcugccaucaccucuaacggacccuugcuaucuacagucggcuccuacgacugggccggcggcguguuccucuacaccuccaaagaaaaauccacguucauaaacaugacacgagucgacucggacaugaaugacgcguaccuugguuaugcugccgcaauuauacuuagaaaccgugugcaaucccuuguacucggcgcucccagauaucaacacaucggccucgucgcuauguuucgucaaaauaccgggaugugggaauccaacgccaaugucaaaggcacccaaaucggcgccuacuucggcgcgagccuaugcucagucgacgucgacucaaacggauccaccgaucuaguccugaucggagcaccacacuauuacgaacaaaccagaggcggccagguaucagucugcccacucccccgaggccgcgcccgcuggcaaugcgacgccguccuuuacggcgagcagggccagccuuggggacgauucggagccgcccucaccguacucggugacguuaacggagauaaacuaacagacgucgcaaucggcgcccccggagaagaagacaacagaggagcggucuaccucuuucacggaaccuccgggagcggaaucagcccgucccauucccagcgcauugcagguagcaaacucaguccccgccuccaguacuucggccaaucccuguccggcggccaagaccuuacaauggacggccuaguagaccucaccgucggugcucagggccauguccugcuucuacgcucucaaccagucuuacgaguaaaagcaauaauggaguucaacccacgcgaagucgcccgcaacgucuucgaaugcaacgaccaggucguaaaaggcaaagaagccggagaaguccguguaugccugcacguacaaaaguccacccgcgaccgccuacgggaaggccaaauacagucugucgucacuuaugaccucgcucucgacuccggaagaccgcacucucgggccgucuuuaacgaaaccaaaaacucaacacgacgacaaacacaggugcucggccugacgcagacaugcgagacgcucaaauugcagcuaccaaacugcaucgaagacccaguaagcccuauuguccuucgccuaaacuucagccucguggggacaccacuaagcgccuucggcaaccuacgcccgguacucgcggaagacgcccagcgccucuucaccgcccuuuuucccuucgagaaaaacugcggcaacgauaacaucugccaagacgaucugucgaucaccuucagcuucaugucccucgacugucucguagucggaggcccccgugaguucaacguaaccguaaccguccgcaacgacggagaagacagcuaccgcacucaggucaccuuuuucuucccccucgaccugucuuacagaaaaguaucaacacuccaaaaccaacgaucccaacguucauggcgacuagccugcgaauccgccagcuccacugaagucagcggcgcccucaaaagcacguccugcucgaucaaccaccccauauuccccgagaacucagaagucacauucaacaucacauucgacguagauucaaaggcuucacucggaaauaaacugcuucucaaagccaacgucaccucagaaaauaauaugccccguacuaacaaaaccgaguuucaacuagaacucccggucaaauacgccgucuacaugguaguaaccucucacggaguauccaccaaguaccucaacuucacugcauccgaaaacacuucucgcgucaugcagcaccaauaucaagucuccaaccucggucaacguucacugcccaucucccuaguauuccuggucccaguacgccuaaaccagaccgucauaugggacagaccccaagucaccuucucagaaaaccuuagcucuaccugccauacaaaggaaagauuacccucacacuccgacuuucucgcagagcucaggaaagcccccguagucaacugcucgauagcaguaugccaacgaauacaaugcgauaucccauucuuuggcauccaggaagaguucaacgccacccugaaggguaaccucucauucgacugguacauaaagacaucacauaaccaucuacuuauagucagcacagccgaaauccuguucaacgacucaguguucacccuccugcccggccaaggagccuucguacgcucacaaaccgaaacaaaaguugaaccuuucgaaguucccaacccccuuccgcucauagucggcuccucagucggaggccuccuccuacucgcccuaauaaccgcagccuuguacaaacucggauucuucaaacgccaguacaaagacaugaugucagaaggagguccucccggcgcagaaccacaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4620 - RNA, 1751 nt, Artificial Sequence
  mRNA product Design3 comprising derived and/or modified sequence from Homo sapiens__NP_002415.1__HsMMP8 (opt8)
gggagagucccgcagucggcguccagcggcucugcuuguucgugugugugucguugcaggccuuauucaagcuuaccauguucucacuaaaaacccuacccuuucuccuacuccuucacguccagauaucaaaagccuuccccgucuccucuaaagagaaaaacaccaaaaccgugcaagacuaccucgaaaaauucuaccaacucccguccaaccaauaccaaucaacacgcaaaaacggcacuaacguaaucgucgaaaaauugaaagaaaugcaacgauucuucggccucaacgucaccggcaaacccaacgaagaaacccucgacaugaugaagaaaccccgaugcggaguacccgacucuggcggcuucaugcucacucccggcaaucccaaaugggaacgcacuaaccucaccuaccgcaucagaaauuacacaccccaacucucagaagccgaagucgaaagagcgauuaaagacgcauucgaacuaugguccgucgccagcccccuaaucuucacccgcaucucccaaggugaagccgacaucaacauagcauucuaccaacgcgaccacggugacaacuccccauucgacggcccaaacggcauacuugcccacgcauuccaacccggucaaggaaucggaggcgacgcccacuucgacgccgaagaaaccuggaccaacacauccgcaaacuacaaccuauuccucguugccgcccacgaguucggccacucccuaggcuuagcacacuccuccgauccaggugcccuaauguauccaaacuacgccuuccgcgaaaccuccaauuacucccuaccccaagaugacaucgacggaauccaagcaaucuacggacucucauccaaccccauccaacccaccgguccaucaaccccaaaacccugcgaccccucccucaccuucgacgcaaucaccacucucagaggugaaauccucuucuucaaagaccguuacuucuggcgaagacacccacaacuccaacgcgucgaaaugaacuuuauuucacucuucuggcccucgcuucccaccggcauccaggccgcauacgaagacuucgaccgcgaccuaaucuuccucuucaaagguaaccaauacugggcacuaucaggcuacgacauccuucaaggcuaccccaaagacauauccaacuacggcuucccauccuccguccaggcaaucgacgcugcagucuucuauagauccaaaaccuacuucuucgucaacgaccaauucuggcgauacgacaaccaacgacaauucauggaacccggcuaccccaaaucaaucuccggcgcuuuccccggcaucgaauccaaagucgacgccguuuuccaacaagaacacuucuuccacgucuucuccgggccacgauacuacgccuucgaccucaucgcccaacgcgucacccgaguagcacgcggcaacaaauggcuuaacugccguuacggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4621 - RNA, 2471 nt, Artificial Sequence
  mRNA product Design3 comprising derived and/or modified sequence from Homo sapiens__NP_004985.2__HsMMP9 (opt8)
gggagagucccgcagucggcguccagcggcucugcuuguucgugugugugucguugcaggccuuauucaagcuuaccaugucccucuggcaaccccuaguucuaguccuccucguacuuggaugcugcuucgcagcaccccgacaacgccaauccacccuaguccucuucccuggcgaucuucgaacaaaccugaccgaccgccaacucgcggaagaauaucucuaccgcuacggcuacacacguguagccgaaaugcgcggagaauccaaaagccuagguccagcacuccuccuccuccaaaaacaacuuucacuccccgaaacgggcgaacucgacuccgccacccucaaagcaaugagaacaccacgcugcgggguacccgacuuagggagauuccaaacguucgaaggagaccuaaaguggcaccaccacaacauaacuuacuggauacaaaacuacagcgaggaccugccccgagcagucaucgacgacgccuucgcaagagccuucgcccuauggagcgccguaacaccccucaccuucacccguguauacucccgagacgccgacauugucauccaauucggcguagccgaacacggagacggcuacccauucgacggcaaagacggccuauuggcacacgcauuuccacccggcccaggaauacaaggcgacgcccacuuugacgaugacgaacucuggagccugggaaaaggagucguaguccccaccagauucggcaacgcagacggagcagcaugccacuuccccuuuauauucgaaggccgcucuuacagcgccugcacuaccgauggccgcuccgauggucuacccuggugcuccaccaccgccaacuacgacaccgaugaucgcuucgguuucuguccaucugaaagacucuacacccaggacggcaacgccgacggcaaacccugccaauuuccauucaucuuccaaggccaaucuuacuccgcaugcaccacagacggccgauccgauggauaucgcuggugcgccacaacugccaauuacgaccgagacaaacucuucggauucugcccaacccgagcagacucaaccguaaugggaggaaacucagccggcgaauuaugcguauuucccuucaccuuccucggaaaagaguacuccacgugcaccagcgaaggccgaggagacggacgacuauggugcgccaccacaucaaacuucgacuccgacaagaaauggggcuucugccccgaucaaggcuacucucuguucuuagucgccgcacacgaguucggacacgcccugggacuagaccacaguucaguccccgaagcgcucauguaccccauguaccgcuucacagaaggaccaccacuacacaaggacgacguaaacggcaucagacaccuauaugguccccgaccagaacccgaaccacgcccucccacuaccacuaccccacaaccaacugccccacccacaguauguccaacaggaccacccaccguacaccccuccgaacgccccaccgccggcccuaccggaccucccuccgcaggucccacaggaccacccacagccggccccuccaccgccaccacaguucccuuauccccugucgacgacgcaugcaacgucaacauauucgacgcuaucgccgaaaucggcaaucaacuauaccuguucaaggacggcaaauauuggcgcuucucagaaggccgaggcagccgcccucaagguccauuccucauugccgacaaauggcccgcccuccccagaaaacuugacuccgucuucgaagaacgucucuccaagaaauuauucuucuucucaggccgucaagucugggucuacaccggcgccagcguccucggccccagacgucuagacaaacuuggacucggagccgacgucgcucagguaaccggggcucugcgauccggacgcgggaagauguugcuauucagcggacgcagacuauggcgcuucgacgucaaagcccaaauggucgacccgagauccgccuccgaaguugaccguauguucccaggcgugccccucgacacccacgacguauuccaauaccgcgaaaaagcauacuucugccaggaccgcuuuuauuggcgagucucuucccgaucugaacuuaaccaagucgaccaaguaggauaugucaccuacgacauccuccagugccccgaggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4622 - RNA, 1763 nt, Artificial Sequence
  mRNA product Design3 comprising derived and/or modified sequence from Homo sapiens__NP_002418.1__HsMMP13 (opt8)
gggagagucccgcagucggcguccagcggcucugcuuguucgugugugugucguugcaggccuuauucaagcuuaccaugcacccaggcguccucgcagcuuuccucuuccucuccuggacacacugccgcgcauuaccccuccccucaggaggcgacgaagacgaccucuccgaagaggaccuccaauucgccgaacguuaccuccgcuccuacuaccacccgacaaaccucgcaggaauacucaaggaaaacgccgccuccuccaugaccgaacgccuuagagaaaugcagucauucuucggccuagaaguaaccggaaaacuagacgacaacacccuagacgucaugaaaaaaccccgaugcgguguccccgacgucggcgaauacaacgucuucccccgcacccuuaagugguccaaaaugaaccugaccuaucgcauagucaacuacacgccagacaugacccauuccgaagucgaaaaagcauucaaaaaagcguucaaaguaugguccgacgucaccccacuuaacuucacacgccuccacgacggaaucgcagacaucaugauaagcuucgguaucaaagaacacggcgacuucuaccccuucgacggcccaucaggccuacuagcccacgcauucccccccggcccgaauuacggcggcgacgcccacuuugacgaugacgaaaccuggacauccuccuccaaagguuacaaccuauuccuaguagccgcacacgaauucggccacucccucgggcuagaccacuccaaagaccccggagcccucauguuccccauauacacuuacaccggcaaaucccacuucaugcuacccgacgacgacguacaaggcauccaaucccuguacggcccaggcgacgaagacccaaaccccaaacaccccaaaacucccgacaaaugcgaccccucccucucccuagacgccaucaccucacuccgcggcgaaacaaugauauucaaagaccguuucuucuggcgccuccacccacaacaaguagaugcagaacucuuccuaacaaaauccuucuggcccgaacuaccaaaccgaaucgacgcugcauaugaacauccaucccacgaccucauuuucauauuucgaggccgaaaauucugggcacuaaacgguuacgacauccucgaaggcuaccccaaaaaaaucuccgaacuaggccuucccaaagaaguaaaaaaaaucucagccgccguccacuuugaagacaccggaaagacucuacuauucucaggcaaccaagucuggcgauacgacgacaccaaccacauaauggacaaagacuaccccaggcuaauagaagaagacuuuccaggcaucggagacaaaguagacgccguauacgagaaaaacggcuacaucuacuucuucaacggccccauacaauucgaguacuccaucugguccaaucgaaucguacgcgucaugcccgccaacucaauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4623 - RNA, 1415 nt, Artificial Sequence
  mRNA product Design3 comprising derived and/or modified sequence from Homo sapiens__NP_001286.1__HsCCR1 (opt8)
gggagagucccgcagucggcguccagcggcucugcuuguucgugugugugucguugcaggccuuauucaagcuuaccauggagacccccaacaccacagaagacuacgacaccaccaccgaauucgacuacggugacgccacccccugucaaaaagucaaugaacgcgccuucggcgcacaacuacuaccgccccucuacucgcucguuuucguaaucggccucgucggaaauauacucgucguccucguccuaguccaauacaaacgccucaaaaacaugacuucaaucuaccuccuuaaccuagccaucucugaccuccucuuccuauucacacucccauuuuggaucgauuacaaacucaaagacgacugggucuucggcgacgcaaugugcaaaauccuaucaggcuucuacuacaccggccuauauagcgaaaucuucuucauuauccuucucaccaucgaccgcuaccucgccauaguccacgcagucuucgccuugcgcgcacgcaccguaacuuuuggagucauaaccuccaucaucauuugggcucucgccauccucgccucaaugcccggccuauacuucuccaaaacacaaugggaauucacccaccauacuugcucccuccacuucccacacgagucccuaagagaauggaaacucuuucaagcacucaaauuaaaccucuuuggucucguucuuccccuccucgucaugauaauuugcuacaccggcaucaucaaaauccuccuccgccguccaaacgaaaaaaaauccaaagccguccgccuaaucuucguaauaaugaucaucuucuuccucuucuggacccccuacaaccucacaauccucaucuccgucuuccaagauuuccucuucacccacgaaugcgaacaaucucgucaccucgaccucgcuguccaagucacagaagucaucgcuuacacacacugcugcgucaaccccguaaucuacgcauucgucggugaacgauuccgcaaauaccuccgccaacucuuccaccgccgcguagccguccaccucgucaaauggcuucccuuccucuccgucgaccgacucgaacgcguaucuagcaccuccccuuccacaggagaacacgaacucuccgccggcuucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4624 - RNA, 983 nt, Artificial Sequence
  mRNA product Design3 comprising derived and/or modified sequence from Homo sapiens__NP_002598.4__HsPDGFA (opt8)
gggagagucccgcagucggcguccagcggcucugcuuguucgugugugugucguugcaggccuuauucaagcuuaccaugcgcacccucgccugccuccuccuccucggcugcggcuaccucgcccacguccucgccgaagaagccgagaucccacgcgaaguaaucgaacgccucgcccgcucccaaauacacuccauccgcgaccuccaacgccuccucgaaaucgacucaguaggcuccgaggacucacucgacaccucacuccgcgcccacggcguccacgccaccaaacacguccccgaaaaaagaccacucccaauccgacgaaaacgauccaucgaagaagccguccccgcagucugcaaaacccgcaccgucauauacgaaaucccacgaucccaagucgaccccaccuccgccaacuuccuaaucuggcccccaugcgucgaagucaaacgaugcaccggcugcugcaacacauccuccguaaaaugccaacccagccgcguccaccaccgcuccguaaaaguagcaaaagucgaauacguacgcaaaaaacccaaacuaaaagaaguccaaguccgccucgaagaacaccuagaaugcgcaugcgcaacaacaucccuaaaccccgacuaccgcgaagaagacaccggccgaccacgagaauccggcaaaaaacgcaaacgcaaacgccucaaaccaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4625 - RNA, 1073 nt, Artificial Sequence
  mRNA product Design3 comprising derived and/or modified sequence from Homo sapiens__NP_002599.1__HsPDGFB (opt8)
gggagagucccgcagucggcguccagcggcucugcuuguucgugugugugucguugcaggccuuauucaagcuuaccaugaaccgaugcugggcacucuuccuaucccucugcugcuaccuacgccuagucucagccgaaggcgaccccauccccgaagaacucuacgaaaugcucagcgaccacuccauccgaagcuucgacgaccuucaacgccuacuccacggcgaccccggcgaagaagacggagccgaacucgaccuaaacaugacccgcucccacuccggcggagaacucgaaucacucgcacgcggacgcagaucccucggcucccucaccaucgccgaaccagccaugauagcagaaugcaaaacccgaacagaagucuucgaaaucucacgccgccucauagaccgaaccaacgccaacuuccucgucuggcccccaugcgucgaaguccaaagaugcuccggcugcugcaacaaccgcaacguccaaugccgcccaacccaaguccaacuccgcccaguccaaguacgcaaaaucgaaaucguacgcaaaaaaccaaucuucaaaaaagccaccgucacccuagaagaccaccucgccugcaaaugcgaaaccguagccgcagcccgacccguaacacgcucucccggcggcagccaagaacaacgagcaaaaacaccccaaacacgcgucacaaucaggaccguccgcguccgcagacccccaaaaggcaaacaccgcaaauucaaacacacccacgacaaaaccgcacucaaagaaacccuaggcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4626 - RNA, 1385 nt, Artificial Sequence
  mRNA product Design3 comprising derived and/or modified sequence from Homo sapiens__NP_057289.1__HsPDGFC (opt8)
gggagagucccgcagucggcguccagcggcucugcuuguucgugugugugucguugcaggccuuauucaagcuuaccaugucccucuucggccuccuccuccucaccucagcccuagcaggccaacgccaaggcacccaagccgaauccaaccucuccuccaaauuccaauucucauccaacaaagaacaaaacggcguacaagacccgcaacaugaacgcauaaucaccguauccaccaacggcagcauccacuccccaagguucccccauaccuacccccgcaacaccguccuagucuggcgccuugucgccgucgaagaaaacgucuggauccaacugacauucgacgaacgcuucggccucgaagaccccgaagacgacaucugcaaauacgauuucgucgaaguagaagaaccuuccgauggcaccauccucggccgcuggugcggaagcggcaccguccccggcaaacaaaucucaaaaggcaaccaaauacgcauccgauucgucuccgacgaauacuucccaucagaacccggauucugcauacacuacaacaucgucaugccacaauucaccgaagccgucucacccuccguccuaccccccucagcccucccccucgaccuacucaacaacgccauaacagccuuuuccacccucgaagaccucauccgauaccucgaaccagaacgauggcagcucgaccuagaagaccucuaccgccccaccuggcaacucuuaggcaaagccuucgucuucggccgcaaaucgcgcguaguugaccuuaaccuccuaaccgaagaaguacgccucuacagcugcaccccacgcaacuucuccguaucaauccgcgaagaacucaaacguaccgacaccauauucuggcccggaugccuccuagucaaaagaugcggcggaaacugcgccugcugccuccauaacugcaacgaaugccaaugcguacccuccaaaguaaccaaaaaauaccacgaaguccuucaacuccgcccaaaaacaggcguacguggccuccauaaaucacuuaccgacgucgcccucgaacaccacgaagaaugugacugcgucugucgcggauccaccggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4627 - RNA, 1442 nt, Artificial Sequence
  mRNA product Design3 comprising derived and/or modified sequence from Homo sapiens__NP_149126.1__HsPDGFD (opt8)
gggagagucccgcagucggcguccagcggcucugcuuguucgugugugugucguugcaggccuuauucaagcuuaccaugcaccgccucaucuucgucuacacccuaaucugcgccaauuucugcucaugccgcgacaccucugccacaccgcaaagcgcuucaaucaaagcacuccggaacgccaaccugcgacgagacgaccucuaccgccgcgacgaaaccauccaagucaaaggaaacggcuacguacaaagcccccgauucccaaacuccuacccccgcaaccuccuacucaccuggagacuacacucccaagaaaacacccgaauacaacucguauucgacaaccaauucggacuagaagaagcugaaaacgacaucugccgauacgacuucguagaagucgaagacauaagcgaaacauccacaaucaucagaggccgcuggugcggccacaaagaaguaccaccccgcaucaaaucccgcacaaaccaaaucaagauaaccuucaaaucagacgacuacuucgucgccaaacccggauucaaaaucuacuacucccuccuagaagacuuccaacccgccgccgccuccgaaacaaacugggaaucagucaccucaagcaucucagguguaucauacaacucccccuccgucaccgaccccacacucauagcagacgcccucgacaagaaaauagcugaauuugacaccgucgaagaccuccucaaauacuucaaccccgaauccuggcaagaagaccucgaaaacauguaccuggauacaccacgcuacagaggccgaucauaccacgaccgaaaaaguaaagucgaccuugaccgccucaacgacgacgccaaacgcuauagcugcaccccucgaaacuacuccgucaacauccgagaagaacuaaaacucgcaaacgucguauucuucccacguugccuccuuguccagcgaugcggaggcaacugcggcugcggcaccgucaacuggcggagcugcacaugcaacuccggcaaaaccguaaagaaauaccacgaaguacuccaauucgaaccaggucacaucaaacgucgcggcagagcuaaaaccauggcauuagucgacauacaacuagaccaccacgaacgaugcgacugcaucugcagcucacgacccccacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4628 - RNA, 1025 nt, Artificial Sequence
  mRNA product Design3 comprising derived and/or modified sequence from Homo sapiens__NP_003946.3__HsSOCS3 (opt8)
gggagagucccgcagucggcguccagcggcucugcuuguucgugugugugucguugcaggccuuauucaagcuuaccauggucacacacuccaaauuccccgccgccggcaugucccgacccuuagacaccuccuuacgccuaaaaaccuucuccuccaaauccgaauaccaacucguagucaacgcaguacgcaaacuccaagaauccggauucuacuggucagccguaaccggcggcgaagccaaccuccuccuauccgccgaaccagccggcaccuuccuaauucgcgacucauccgaccaacgccacuucuucacccucuccgucaaaacccaauccggcacaaaaaaccuccgcauccaaugcgaaggcggaucauucuccuuacaauccgacccccgcuccacccaaccagucccccgauucgacugcguacucaaacucguccaccacuacaugccaccccccggcgcccccuccuucccuucaccccccaccgaacccuccuccgaagucccugaacaacccucagcccaacccuuacccggcucccccccacgccgcgcauacuacaucuacucaggcggcgaaaaaaucccacucguccucucccgcccccucuccuccaauguagccacacuccaacaccucugccgcaaaaccgucaacggccaccuagacuccuacgaaaaaguaacccaacuccccggacccauacgcgaauuccuagaccaauacgacgccccacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4629 - RNA, 830 nt, Artificial Sequence
  mRNA product Design3 comprising derived and/or modified sequence from Homo sapiens__NP_003227.1__HsTGFA (opt8)
gggagagucccgcagucggcguccagcggcucugcuuguucgugugugugucguugcaggccuuauucaagcuuaccaugguccccuccgccggccaacucgcccucuucgcccucggcauaguacucgcagccugccaagcccuagaaaacucuaccuccccccucuccgccgaccccccaguagcagccgccgucgucucacacuucaaugacugcccagacucccacacccaauucugcuuccacggcaccugccgcuuccucguacaagaagacaaacccgccugcguaugccauuccggauaugucggcgcccgcugcgaacacgccgaccuccuagcaguagucgcagcaucacaaaaaaaacaagcaaucacagcacuugucgucgucucaaucgucgcccucgccguacuaaucaucaccugcguccucauccacugcugccaaguccgaaaacacugcgaauggugccgagcacucaucugccgccacgaaaaacccucagcccuacucaaaggccgaaccgcaugcugccacuccgaaacagucgucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4630 - RNA, 1520 nt, Artificial Sequence
  mRNA product Design3 comprising derived and/or modified sequence from Homo sapiens__NP_000651.3__HsTGFB1 (opt8)
gggagagucccgcagucggcguccagcggcucugcuuguucgugugugugucguugcaggccuuauucaagcuuaccaugccuccauccggccuacgacuacuccccuuacuccuaccccuccuauggcuccuaguccuaacacccggccgccccgcagccggccuaucgaccugcaaaaccaucgacauggaacucgucaaacgcaaacgcaucgaagccauucgaggacaaauccuauccaaacucagacucgccucaccucccucccagggcgaaguaccacccggcccccuucccgaagcaguccucgcccucuacaacucaacaagagaccgcgucgccggcgaauccgccgaacccgaacccgaacccgaagccgacuacuacgccaaagaaguuacccgagugcuaauggucgaaacccacaacgaaaucuacgacaaauucaagcagucaacacacucaauauacauguucuuuaauaccucagaacuccgcgaagcaguaccugaacccguccuccuaucccgcgccgaacuccgacuucucagacucaaacuuaaggucgaacaacacgucgaacucuaccaaaaauacuccaauaauucauggcgcuaccucuccaaucgacuccuugcccccuccgacucacccgaauggcucuccuucgacgucaccggagucguacgccaguggcucucccgcggcggcgaaaucgaaggcuuccgccucuccgcacacugcuccugugacucccgcgacaauacccuacaagucgacaucaacggcuucaccaccggccgacgcggcgaucucgccaccauccacggcaugaaccgcccauuccuccuccuaauggccacaccccucgaacgugcccaacaucugcaaucaucccgccaccgacgugcccucgacaccaacuacugcuucuccucaaccgagaaaaauugcugcguacgacaacuauacaucgacuuccgcaaagaccucggauggaaguggauccacgaacccaaaggauaccacgccaacuucugccucggccccugccccuacaucuggucccucgacacacaauacuccaaaguucucgcccucuacaaccaacacaaucccggcgcaucagcagcccccugcugcgucccccaagcccuagaaccccucccaaucgucuacuacgucggccgaaaaccaaaagucgaacaauuauccaacaugaucguccgcagcugcaaaugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4631 - RNA, 1592 nt, Artificial Sequence
  mRNA product Design3 comprising derived and/or modified sequence from Homo sapiens__NP_003229.1__HsTGFB2 (opt8)
gggagagucccgcagucggcguccagcggcucugcuuguucgugugugugucguugcaggccuuauucaagcuuaccaugcacuacugcguacucuccgcauuccucauacuccaccucgucaccgucgccuuaucuuuauccacaugcucaacccucgacauggaccaauucaugcgcaaacgcaucgaagccauccgaggacaaaucuuaucaaaacucaaacuaaccuccccacccgaagacuaccccgaaccagaagaagucccacccgaagucauuuccauuuacaacuccacacgcgaccugcuacaagaaaaagccucccgccgcgccgccgcaugcgaacgcgaacgcucagacgaagaauacuacgccaaagaagucuacaaaaucgacaugccacccuucuuccccuccgaaaacgccaucccacccaccuucuacagacccuacuuccguaucguccgcuuugacgucagcgcaauggagaaaaacgccaguaaccuugucaaagccgaguuccgaguauuccgccuacaaaacccaaaagcccgcgucccagaacaacgcaucgaacucuaccaaauccuaaaauccaaagaccuaacuucucccacccaacgauacauagacucaaaaguugucaagacccgcgcagaaggugaauggcucagcuucgacguaacugacgccguccacgaauggcuacaccauaaagaccgaaaccuaggcuucaaaauaagccuccacugcccaugcugcacauucguccccucgaacaacuauaucaucccgaacaaaucagaggaacuggaagcccgcuucgccggaaucgacggaaccuccaccuacaccuccggcgaccagaaaaccauuaaaucaacccgcaaaaagaacagcggaaaaaccccacaccuccuacucaugcuacuaccauccuaccgacuagaaucacaacaaaccaaccgcagaaagaaacgcgcccucgaugccgccuacugcuucaggaacguccaagacaacugcugccuacgcccccuauacaucgacuucaaacgcgaccucggauggaaauggauccacgaaccuaaaggcuacaacgcaaacuucugcgccggagcaugccccuaccucuggagcuccgacacacaacacucucgcguccucucccuauacaacaccaucaaccccgaagccuccgccucacccugcugcgucucccaagaccucgaaccccucacaauacuauacuacaucggcaaaacccccaaaaucgaacaacuguccaacaugaucgucaaauccugcaaaugcagcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4632 - RNA, 1586 nt, Artificial Sequence
  mRNA product Design3 comprising derived and/or modified sequence from Homo sapiens__NP_003230.1__HsTGFB3 (opt8)
gggagagucccgcagucggcguccagcggcucugcuuguucgugugugugucguugcaggccuuauucaagcuuaccaugaagaugcaccuccaacgcgcccucguaguccucgcccuccucaacuucgccacagucagccucucccuaucaaccugcaccacccuagacuucggccacaucaaaaagaaaagagucgaagccauccgcggccaaauccucuccaaacuccgucucaccagcccacccgaacccaccgucaugacccacgucccauaccaaguccucgcccuauacaacuccacgcgcgaacuacuagaagaaaugcacggagaaagagaagaaggaugcacccaagaaaacacagaaucagaauacuacgcaaaagaaauccacaaauucgacaugauccaaggacucgccgaacacaacgaacucgccgugugccccaaaggcaucaccucuaaagucuuccgauucaacgucuccucaguagagaaaaaccgcaccaaccucuucagagccgaguuccgaguccucagaguccccaaccccucuucaaaacgcaacgaacaacgcauugaacuguuccaaauccuacgaccagacgaacacaucgcuaaacaacgauacauaggaggcaaaaaccugcccacccgaggaacagcagaauggcucuccuucgacgucaccgacaccguccgcgaauggcucuuacgccgagaauccaaccuuggacuagaaaucuccauacacugccccugccacaccuuccagcccaacggagacauacucgaaaacauccacgaagucauggaaaucaaauucaaaggaguagauaacgaagacgaccacggacgcggcgaccucggccgacucaagaaacaaaaagaccaccacaacccgcaccucauacugaugaugaucccaccccaucgccucgauaaccccggccagggcggccaacggaagaaacgagcacucgacaccaacuauugcuucagaaaccucgaagaaaacugcugcgucagaccccucuacaucgacuuccgccaagaccuaggcuggaaauggguacacgaaccaaaaggcuacuacgccaacuucugcagcggacccugcccauaccuccgaucggcagacaccacccacucaaccguccucggccucuacaacacccuuaaccccgaagcauccgcaucccccugcugcguaccgcaagaccuagaaccccucaccauacuauacuacgucggccgaaccccaaaagucgaacaauuauccaacauggucgucaaauccugcaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4633 - RNA, 1733 nt, Artificial Sequence
  mRNA product Design3 comprising derived and/or modified sequence from Homo sapiens__NP_001057.1__HsTNFRSF1B (opt8)
gggagagucccgcagucggcguccagcggcucugcuuguucgugugugugucguugcaggccuuauucaagcuuaccauggcaccaguagccgucugggccgccuuggccguuggccuagaacucugggccgcagcccacgcccugccagcccaagucgcauucaccccuuacgcccccgaacccggcagcacaugccgacuccgcgaauacuacgaccaaacggcacagaugugcugcucuaaaugcagcccaggccaacacgcaaaagucuucuguacaaaaaccagcgacaccguaugcgacuccugcgaagacuccacuuauacccaacucuggaacuggguccccgaaugccucucuugcggcagccgcugcucauccgaucaagucgaaacccaagccuguacccgcgaacaaaacagaaucuguaccugcagacccggcugguacugcgcccucuccaaacaagaaggaugccgacuaugcgccccucuccgcaaaugccgcccaggauucggcguagcacgccccggcaccgaaaccucagacgucgucugcaaaccuugugcgcccggaacauucagcaacaccaccucauccaccgacaucugcagaccccaucaaauaugcaacgucgucgcuauccccggaaacgcaucaauggacgcugucugcaccucaaccucucccaccagauccauggcaccaggggccguccaccuaccccaacccgucuccacucgaucccaacacacccaacccacaccagaaccguccaccgccccauccaccuccuuccuccuccccaugggcccauccccgcccgccgaagguucuaccggagacuucgcccuucccgucggccuuaucgucggugucaccgcacucggacuccucaucauaggcgucgucaacugcgucaucaugacacaaguaaagaagaaaccacuuugccuacaacgagaagccaaaguaccccaccuccccgcagacaaagcccguggcacccaaggacccgagcaacaacaccuccuaauaaccgcccccucauccuccuccucaucacucgaaucauccgccucagcacucgaccgcagagcgcccacccgcaaccaaccacaagcccccgguguagaagccuccggcgcuggcgaagcccgcgccuccacaggaucuuccgacucuucacccggcggccacggcacccaagucaacguaaccugcauagucaacguaugcuccuccuccgaccacuccucacaaugcaguucccaagcaucaucaacaaugggagacacagacuccucccccuccgaauccccaaaagacgaacaagucccauuuucaaaagaagaaugugccuucagaucccaacucgaaacaccagaaacccuacuuggcuccacagaagaaaaaccccucccccuaggcguucccgacgcuggcaugaaaccauccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4634 - RNA, 860 nt, Artificial Sequence
  mRNA product Design3 comprising derived and/or modified sequence from Homo sapiens__NP_002623.2__HsPGF (opt8)
gggagagucccgcagucggcguccagcggcucugcuuguucgugugugugucguugcaggccuuauucaagcuuaccaugccggucaugagauuguucccgugcuuucuccagcuauuggccggguuagcacuaccggcagugcccccacaacagugggcgcucucggccgggaacgggagcucggaaguggaagugguaccauuccaggaagugugggggcgcucguacugucgagcgcucgagcgauugguagaugucgugagcgaguacccaagcgagguagagcacauguucucacccucaugcgugagcuugcucaggugcacgggcuguugcggggacgagaacuugcacugugucccgguagagaccgcgaacgugaccaugcaacugcucaagaucagaagcggggacaggcccucguacguggaauugaccuuuagccagcacgugcgcugugaaugucgcccgcucagagaaaagaugaagcccgagcgcagacgaccgaaagggcgcgggaaaaggcgcagggaaaagcaaaggcccacggacugucacuugugcggggacgcggucccgcgcagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4635 - RNA, 1586 nt, Artificial Sequence
  mRNA product Design3 comprising derived and/or modified sequence from Homo sapiens__NP_001020537.2__HsVEGFA (opt8)
gggagagucccgcagucggcguccagcggcucugcuuguucgugugugugucguugcaggccuuauucaagcuuaccaugaccgaccgccagaccgacaccgcgcccucgccaucauaccaucucuugcccggacgcaggagaacagucgaugccgcggcaucgcgagggcaaggaccagagcccgcaccaggaggaggggucgaggggguaggagcgcgcggaguagcgcucaaacuguucguacaacugcuaggcugcaguagguucgggggagcggucguacgcgcgggggaggccgaaccaagcggcgcggccagaagcgcaagcagcggcagggaagaaccacagcccgaggaaggagaagaggaagaggaaaaagaagaggaaaggggcccacaguggcgacugggagcgcgcaagcccgggagcuggaccggagaagcggcagugugcgcggacucggccccggcagcacgcgcgccacaggcccuggccagagccucaggcaggggcgggcgcguggccaggcgcggggcagaagaaucaggaccgccccacagcccaagcaggcgagggagcgcaaguagggccgggcccggccgcgcgagcgaaaccaugaacuuccuccugagcuggguccacuggucgcucgcgcuauugcucuaccuccaccacgcgaaauggagccaggccgcgcccauggcagaaggaggcgggcagaaccaccacgagguagugaaauucauggacguauaccaaaggagcuacugccaccccauagaaacgcuuguggacauauuccaagaauaccccgacgaaaucgaauacauauucaaaccgagcugcgucccacucaugcgcugcggagggugcugcaacgacgaagggcucgaaugcgugcccacggaagagagcaauaucacgaugcaaaucaugcgcauaaaaccgcaccaggggcaacacauaggggagaugucguuccuacaacacaacaaaugcgaaugccgacccaagaaagaucgagcacgccaggaaaagaaaucagucaggggcaaaggaaagggccagaaaagaaaaagaaagaaaagccgguacaaaagcuggagcguauacgugggcgcgcgaugcugccuaaugccguggagccuaccgggaccgcacccaugcggacccugcagcgagagaagaaaacaccuauucguacaggacccgcagacaugcaaaugcucgugcaagaacacagauucgcgaugcaaagcacgacagcucgagcucaaugaaaggacaugcagaugugacaaaccccgacgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4636 - RNA, 1046 nt, Artificial Sequence
  mRNA product Design3 comprising derived and/or modified sequence from Homo sapiens__NP_001165094.1__HsVEGFA (opt8)
gggagagucccgcagucggcguccagcggcucugcuuguucgugugugugucguugcaggccuuauucaagcuuaccaugaacuuccuccucuccuggguccacuggucccuagcccuccuacuauaccuccaccacgccaaauggagccaagccgcccccauggccgagggcggcggacaaaaccaccacgaagucguaaaauucauggacguauaccaacgaagcuacugccaccccaucgaaacccucguagacauauuccaagaauaccccgacgaaaucgaauacaucuucaaaccaagcugcguaccccuaaugcgaugcggcggcugcugcaacgacgaaggccucgaaugcguacccaccgaagaaagcaacaucacaaugcaaaucaugagaaucaaaccccaccaaggccaacacauaggcgaaauguccuuccuccaacacaacaagugcgaaugccgccccaaaaaagaccgcgcccgccaagaaaagaaauccguccguggaaaaggcaaaggccaaaaacgaaaacgaaaaaaaagccgcuacaaauccuggagcgucuacguaggcgcccgaugcugccuaaugccauggucccuccccggcccccaccccugcggccccugcuccgaacgccgaaaacaccucuucguccaagacccacaaaccugcaaaugcuccugcaaaaacacagacucacgcugcaaagcaagacaacucgaacuaaacgaacgcaccugccgcugugacaaaccacgacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4637 - RNA, 971 nt, Artificial Sequence
  mRNA product Design3 comprising derived and/or modified sequence from Homo sapiens__NP_003368.1__HsVEGFB (opt8)
gggagagucccgcagucggcguccagcggcucugcuuguucgugugugugucguugcaggccuuauucaagcuuaccaugucaccacuacuccgccgacuacuccucgccgcccuccuccaacucgcccccgcccaagcccccgucagccaacccgacgccccaggccaccaacgcaaagucgucuccuggaucgacguuuacacucgcgcaacaugccaaccccgcgaaguagucgucccacucaccgucgaacuaaugggcaccgucgccaaacaacucguccccucaugcgucaccguccaacgcugcggaggaugcugccccgacgacggccuagaaugcgucccaaccggccaacaccaaguacgcaugcaaauacucaugauccgauaccccucaucccaacuaggcgagaugucccucgaagaacacucccaaugcgaaugccgacccaaaaaaaaagacuccgccgucaaacccgaccgagccgccacaccccaccaccgcccacaaccccgcuccgucccaggcugggacucagcccccggcgcaccaucacccgccgacaucacccaccccacacccgcacccggccccuccgcccacgccgcccccucaaccaccuccgcacuaacccccggccccgccgccgccgccgccgacgccgccgcaucaucaguagcaaaaggcggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4638 - RNA, 1607 nt, Artificial Sequence
  mRNA product Design3 comprising derived and/or modified sequence from Homo sapiens__NP_005420.1__HsVEGFC (opt8)
gggagagucccgcagucggcguccagcggcucugcuuguucgugugugugucguugcaggccuuauucaagcuuaccaugcaccuccucggauucuucucaguagccugcucccuucuggccgcagcccuccuccccggcccgcgcgaagcccccgccgccgccgcagccuucgaauccggccuagaccugagcgacgccgagcccgacgcaggagaagccaccgccuaugccuccaaagaccucgaagaacaauugcgcucggucucgucagucgacgaacucaugaccguccucuacccagaauacuggaaaauguauaaaugccaacuccgcaaagguggcuggcaacacaaccgggaacaagccaaccucaacagccgaacagaagaaacaaucaaauucgccgcagcccacuacaacacagaaauccucaaauccauagacaacgaauggcgcaaaacccaaugcaugccccgcgaagugugcaucgacguaggcaaagaguucggcgucgccacaaacacauucuucaaaccaccgugcgucuccgucuaccgcuguggcggaugcugcaacucggaaggacuacaaugcaugaacacguccaccuccuaccucuccaaaacccucuucgaaauaaccguaccacuaucccaggguccaaaacccguaacaauauccuucgcaaaccauacuuccugccgaugcauguccaaacuugacgucuacagacagguacacagcauaauccggcguucccuacccgcuacccuaccacaaugccaagcagccaauaaaaccuguccaacaaacuacauguggaacaaccacaucugucgcugccucgcccaagaagacuucauguucuccucagacgccggcgacgacucaacagacggcuuccacgacaucuguggcccaaacaaagaacuugaugaagaaacaugccaaugcgucugccgagccggacuccgacccgcaagcugcggcccccauaaagaacuagaccggaacucaugccaaugcguauguaaaaauaaacuauuccccucccaaugcggcgccaaccgggaguucgacgaaaauaccugccaaugcguaugcaaacgcacuugcccacgcaaccaaccccuaaaccccggcaaaugcgccugcgaaugcaccgaaucgccccaaaaaugccuacucaaaggcaagaaauuccaccaccaaaccugcuccuguuaccgccgacccugcaccaaccgccaaaaagccugcgaacccgguuucucauacucagaagaggucugccgaugcguccccagcuauuggaaacgcccacaaauguccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4639 - RNA, 1412 nt, Artificial Sequence
  mRNA product Design3 comprising derived and/or modified sequence from Homo sapiens__NP_004460.1__HsVEGFD (opt8)
gggagagucccgcagucggcguccagcggcucugcuuguucgugugugugucguugcaggccuuauucaagcuuaccauguaccgugaaugggucgucgucaacguauucaugaugcuauacguucaacucguccaaggauccucaaaugaacacggcccagucaaacgcagcucccaauccacacucgaacgcuccgaacaacaaauccgcgccgccuccucccucgaagaacuacuucgcaucacccauucagaagacuggaaacuauggcgaugccgccuccgccucaaaucauuuaccucaauggacagccgcucagccucccaccgcuccacacgcuucgcggccacuuuuuacgacauagaaaccuuaaaagucauagaugaagaauggcaacgcacacaaugcucccccagagaaaccugcgucgaagucgccuccgaacucggcaaaucaaccaacaccuucuucaaacccccaugcgucaacguauuccguugcggaggcugcugcaacgaggaaucauuaaucugcaugaacacaagcacauccuacaucuccaaacaacucuucgaaaucucuguaccccucaccuccguccccgaauuaguaccugucaaagucgcaaaccacacaggaugcaagugccucccuaccgcaccccgccaccccuacuccauaauccggcgauccauccaaauccccgaagaagaccgaugcucacacucaaagaaacucugccccaucgacaugcucugggacuccaacaaaugcaaaugcguccuccaagaagaaaacccccuagccggcaccgaggaccacucccaccuacaagaaccagcccucugcggcccccacaugauguucgacgaagaccgaugcgaaugcgucugcaaaacccccugccccaaagaccucauccaacaccccaaaaacugcuccugcuucgaaugcaaagaaucccuagaaaccugcugccaaaaacacaaacuauuccacccagauaccugcucaugcgaagaccgcugccccuuccacacacgccccugcgccuccggcaaaaccgccugcgccaaacacugccgauuccccaaagaaaaacgcgccgcccaaggaccccacucccgcaaaaaccccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4640 - RNA, 977 nt, Artificial Sequence
  mRNA product Design3 comprising derived and/or modified sequence from Homo sapiens__NP_061986.1__HsFGF21 (opt9)
gggagagucccgcagucggcguccagcggcucugcuuguucgugugugugucguugcaggccuuauucaagcuuaccauggacuccgacgaaaccggcuucgaacacuccggccucugggucuccguccucgccggccuccuccuaggcgccugccaagcacaccccauacccgauucuuccccacuacuccaauucggcggccaaguccgccaacgcuaccucuacacagacgacgcccaacaaacagaagcccaccuagaaauccgagaagacggcacagucggaggcgccgccgaccaaucacccgaaucccuccuacaacuaaaagcccucaaacccggcgucauccaaauccucggcgucaaaaccagccgauuccucugccaacgccccgacggcgcccucuacggaucccuacacuucgacccagaagccugcuccuuccgcgaacuccuccuagaagacggcuacaacgucuaccaaucagaagcccacggccucccccuccaccuccccggcaacaaaucaccacaccgcgacccagccccacgcggccccgcccgcuuccuuccccuccccggccucccacccgcacuccccgaacccccaggcauccucgcaccccaacccccagacgucggcuccucagacccccucuccauggucggccccucucaaggcagauccccauccuacgccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4641 - RNA, 1757 nt, Artificial Sequence
  mRNA product Design3 comprising derived and/or modified sequence from Homo sapiens__NP_002412.1__HsMMP1 (opt9)
gggagagucccgcagucggcguccagcggcucugcuuguucgugugugugucguugcaggccuuauucaagcuuaccaugcacuccuucccuccccuccuacuacuccucuucuggggcguugucucccacuccuuccccgcgacccuagaaacacaggaacaagacguugaccucguccaaaaauaccuagaaaaauacuacaaccucaaaaacgacggacgccaaguagaaaaacgacgcaacuccggccccgucgucgaaaaacucaaacagaugcaagaguucuucggccucaaggucaccggcaaacccgacgccgaaacacuaaaaguaaugaaacaaccccgcugcggcguacccgacgucgcccaauucguacucaccgaagguaacccacgcugggaacaaacccaccucacuuaccggaucgaaaacuacacccccgaccucccccgcgccgacgucgaccaugccaucgaaaaagccuuccaacucuggucaaacgucacaccccucaccuucaccaaagucucugaaggccaagcagacaucaugauaucauucguacgaggcgaccaccgagacaacucccccuucgacggcccgggaggcaaccuggcacacgccuuccaaccagguccaggaaucggcggcgacgcacacuuugacgaggacgagcgauggaccaacaacuuccgagaauacaaccuccaccgcgucgcagcccacgagcucggccacucacugggacucucacacuccaccgauaucggagcacucauguaucccucuuacacuuucuccggcgacguacaacuagcccaagacgacauagacggaauccaagcaaucuacggacgcucccagaaccccguccagcccaucggaccucaaacaccaaaagccugcgacuccaaacuaacauucgacgccaucacaaccauacgaggcgaagucauguucuucaaagacagauucuacaugcgcacaaacccuuucuaucccgaagucgagcucaacuucaucuccgucuucuggccccaacuccccaacggccuugaagcagccuacgaguucgccgaccgcgacgaaguccgauucuucaaaggaaacaaauacugggccguccaaggccaaaacguccuacauggcuaccccaaagacauauacuccuccuucggcuucccaagaaccgucaaacacaucgacgcagcacucuccgaggaaaacaccggaaaaaccuacuucuucgucgcaaacaaauacuggcgcuacgacgaauacaagcgcucaauggaccccggcuauccaaaaaugaucgcacacgacuuccccggcaucggucacaaagucgaugcuguuuucaugaaagacggcuucuucuacuucuuccacggaacccgccaauacaaauuugacccaaaaaccaaacgcauccucacacuacaaaaagccaacagcugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4642 - RNA, 1517 nt, Artificial Sequence
  mRNA product Design3 comprising derived and/or modified sequence from Homo sapiens__NP_002412.1__HsMMP1(1-19,100-469) (opt9)
gggagagucccgcagucggcguccagcggcucugcuuguucgugugugugucguugcaggccuuauucaagcuuaccaugcacuccuucccaccccuacuccuccuacucuucuggggcguagucucccacucauucguacucaccgaaggcaacccccgaugggaacaaacccaccucaccuaccgcauagaaaacuacacccccgaccucccccgcgccgacguagaccacgccaucgaaaaagccuuccaacucugguccaacguaacaccccucaccuucaccaaagucuccgaaggccaagcagacauaaugauaucauucguccgcggcgaccaccgagacaacucacccuucgacggccccggcggcaacuuagcccacgccuuccagcccggcccaggcauaggcggagacgcacacuucgaugaagacgaacgcuggaccaacaacuuccgcgaauacaaccuccaccgcgucgcagcccacgaacucggccacucccuuggacucucacacuccaccgacaucggagcccuaauguacccaucauacacauucucaggcgacguacaacucgcccaagacgacaucgacggcauacaagcaaucuauggccgcucacagaacccaguacaaccaaucggcccccaaacccccaaagccugcgacuccaaacucaccuucgacgcaauaaccacaauucgaggagaagucauguucuucaaagaccgauucuacaugcgcaccaaccccuucuaccccgaaguagaacucaacuucauauccgucuucuggccucaacuacccaacggccucgaagcagcauacgaguucgccgaccgagacgaaguccgauucuucaaaggcaacaaauacugggccguccaaggccaaaacguccuacacggcuacccaaaagacaucuacucuuccuucggcuucccacgaacaguaaaacacauagacgcagcucucucagaagaaaacaccggcaaaacuuacuucuucguagcaaacaaauacuggcgcuacgacgaauacaaacgcucuauggaccccggauaccccaaaaugauagcucacgacuuccccggcauaggucacaaagucgacgcaguauucaugaaagacggcuucuucuacuucuuccacggcacccgccaauacaaauuugaccccaaaaccaaacgcauccucacccuucaaaaagccaacuccugguuuaacugucgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4643 - RNA, 3704 nt, Artificial Sequence
  mRNA product Design3 comprising derived and/or modified sequence from Clostridium histolyticum__BAA77453.1__ColG (opt9)
gggagagucccgcagucggcguccagcggcucugcuuguucgugugugugucguugcaggccuuauucaagcuuaccaugaaaaagaacauccuaaagauacucauggacagcuacagcaaagaaucgaaaauccaaaccguucgucgaguaaccuccguaagccuccuagccguauaucugaccaugaacacgagcagccucguacuagccaaacccauagaaaacaccaacgauaccucaaucaaaaacguagaaaaacugaggaacgcacccaaugaagaaaacucaaagaaaguugaagacagcaaaaaugacaaggucgaacacgucaaaaacaucgaagaagcaaaaguagagcaaguagcccccgagguaaaaagcaaaagcacgcucagaucagcaagcauugccaacacaaacagcgaaaaauacgacuucgaauaccuaaacggucuaagcuauaccgaacugacgaacuuaauaaagaacaucaaauggaaccaaauaaacggccuauucaacuacuccacaggcagccaaaaauucuucggggacaaaaacagaguacaggcaauaaucaacgcgcuccaggaauccggccguaccuacacggcgaacgacaugaaggggaucgaaacauucaccgaaguacuccgugccggcuucuaccuuggguauuacaaugacggacucagcuaccucaacgaccgcaacuuucaggacaagugcauccccgcaaugaucgcaauccaaaagaacccuaauuucaaauuaggaacagccguacaggacgagguaaucacgagccugggcaaauuaaucggcaacgccucugcgaacgcagaggucgucaacaacugugugccaguccucaagcaguuccgggagaaccugaaucaauacgcacccgacuacguaaagggcacugccgucaacgaacucauaaaaggcauagaguucgacuucucaggcgccgccuacgaaaaagacguuaaaacgaugcccugguacggaaaaauagaccccuucauaaacgaauuaaaagccuuaggccucuacggcaacaucaccagcgcaacggaaugggccucagacguagguaucuacuaucuuuccaaauucggauuauacagcaccaaccgcaacgacauaguacaaucccuagagaaagccgucgauauguacaaauacggaaaaauagcguucguagccauggaacgaaucaccugggacuacgacggcaucggcucaaacggcaagaaagucgaccacgacaaauuccuggacgacgccgaaaaacacuaucuccccaaaaccuacacauucgacaacgggacguucauaauccgcgcgggcgacaaaguauccgaagagaaaaucaaacgccuauacugggccuccagagaaguuaaaagccaauuucaccgggugguggggaacgacaaagcccuagaagucggaaacgccgaugacguccucacaaugaaaaucuucaauagucccgaagaauacaaauucaacaccaacauaaacggcguuagcaccgacaaugggggccuguacaucgaaccccggggcacauucuacaccuacgaaagaacgccucaacaaucuaucuucagucuggaggaguuguuccgccacgaauacacccacuaccuacaagcacguuaccucgucgacggccuauggggccagggacccuuuuacgaaaagaacaggcuaaccugguucgacgagggcacagccgaguucuucgccgggagcacccgcacauccggaguacugcccaggaaaagcauccucggcuaccuugccaaagauaaaguugaccaucgcuacucacugaagaagacccuuaacagcggauaugacgauagcgacuggauguucuacaacuauggguucgcgguagcacacuaccuauaugaaaaagacaugcccacuuucaucaaaaugaauaaggcaauccucaacaccgacgucaaauccuacgacgaaaucauuaagaaacugagcgacgacgcaaacaagaacaccgaguaccagaaccacauccaggagcuagccgacaaguaccagggggcaggaaucccccuaguaucagacgacuaccucaaagaucacggcuacaagaaagcgagcgaaguauacuccgaaauaucgaaggcagcaagccucacgaacacaagcgugacagccgaaaaaucacaauacuucaacaccuucacucuccgggguaccuacacaggcgagaccuccaagggagaauuuaaagacugggacgaaaugagcaaaaagcucgacggcacccucgaaucacucgccaaaaacuccugguccggcuacaagacauuaacugcauacuucacuaauuaccgcgucaccagcgacaacaaaguccaauacgacgucguuuuccacgggguacuaaccgauaacgcagacaucuccaacaacaaagcaccuaucgcaaaagucacgggaccauccacuggggccguuggacgcaauauugaguucucagguaaagacagcaaagacgaggacggcaaaaucgucagcuacgacugggauuucggagacggcgcgacaucacgaggcaaaaacagcguccacgcauauaagaaagccggcaccuacaacguuacacuaaaggucacagacgacaaaggagcaacagcgacagagucauucacaauagagaucaaaaacgaggacacgacgacaccuaucacaaaagaaauggaaccgaacgacgacaucaaagaagccaacggcccaauagucgaaggaguaaccguuaaaggcgaccucaacggcucagaugacgccgauaccuucuacuucgacgucaaggaagacggggacguaacaauugaacuaccauacucagggucaagcaauuucacauggcucgucuacaaagaaggcgacgaucagaaccauauagcaucaggcauagacaaaaacaacucgaaagugggcaccuuuaaaagcacaaaaggccgccacuacguguucauauacaaacacgacagcgccucgaacaucucuuacucacuaaacaucaagggccuaggaaacgagaagcugaaagaaaaagaaaacaacgacucuucagauaaggccaccgucauucccaacuucaacacaacaaugcaaggcucgcugcucggcgacgacuccagagacuauuacuccuucgagguaaaagaagaaggagaagucaacaucgaauuggacaagaaagacgaguucggggugacauggacccuucacccggaauccaacauaaacgacaggauaaccuacgggcaaguagauggaaacaaagugucgaacaaagucaagcuccgacccggcaaauacuacuugcuagucuacaaauacagcggcucuggcaacuacgaacuacgaguaaacaaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4644 - RNA, 3428 nt, Artificial Sequence
  mRNA product Design3 comprising derived and/or modified sequence from Clostridium histolyticum__BAA77453.1__HsALB(1-18)_ColG(111-1118) (opt9)
gggagagucccgcagucggcguccagcggcucugcuuguucgugugugugucguugcaggccuuauucaagcuuaccaugaaaugggugacuuucauuucccugcuguuccucuucagcagcgccuacuccaucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4645 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt9)
gggagagucccgcagucggcguccagcggcucugcuuguucgugugugugucguugcaggccuuauucaagcuuaccaugaagugggugacauucaucucccuacuguucuuauuuaguuccgccuauaguaugaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4646 - RNA, 3452 nt, Artificial Sequence
  mRNA product Design3 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaacuuccucaaaaucauacugaaccgcggaaaaaccaugaagagaaagugccuauccaaaagguuaaugcucgccauaaccauggccacgauauucacagugaacucgacccucccgauuuacgccgccguagacaaaaacaacgcgaccgccgcgguacagaacgaguccaaacgguacacgguauccuaucucaagacccucaacuacuacgacuuggucgaccuucucgucaaaacagagauagaaaaccuucccgaucuauuccaauacucuagcgacgccaaagaguucuacggaaacaaaacaagaaugucguucaucauggacgagaucggccgccgcgcuccucaauacacagaaauagaccacaaaggcauacccacccuggucgaggucguccgcgccggcuucuaccuagguuuccacaacaaagaacuaaacgaaaucaacaagcgcagcuucaaagaaagggucauacccuccauacuggcuauccagaaaaaccccaacuucaaauugggaaccgaaguacaagacaaaauagucucagccacaggccugcucgcagguaacgagacugcaccaccggaagugguaaauaacuucaccccgauacuccaagacuguaucaagaacaucgaccguuacgcccucgacgaucucaaaagcaaagcacucuucaacgugcucgcagcaccaacguaugauaucacugaauaccugagagcaaccaaagaaaaaccggagaacacccccugguacgggaaaaucgacggguucauaaacgaauugaagaaacuggcccuuuacggcaaaauaaacgacaauaacucauggauaaucgacaacggaaucuaccacauagcaccccucggcaaacuccacaguaacaacaaaauagggaucgagacccuaaccgaagugaugaagguuuaccccuaucucucaaugcagcaucuccagagugcagaccaaauaaaaaggcauuacgacucaaaagacgccgagggcaacaagauaccucucgacaaguucaagaaagagggcaaagaaaaguacugccccaaaaccuacacguuugacgaugguaaagucaucauaaaggcaggagcacgagucgaagaagaaaaagucaaacgucuuuacugggccagcaaggaaguaaacagccaguucuuccgagucuacggcaucgacaaaccacucgaggaaggcaacccggaugacauccucacaauggugaucuacaacagcccggaggaguacaaacuuaacuccgucuuguacggcuaugacaccaacaauggcgggauguacaucgaaccagaaggaacuuucuucaccuaugagcgcgaagcccaagaguccaccuauacccucgaggaacucuuccgacacgaauacacucauuacuuacaaggccgcuacgcaguacccgggcaauggggccgcaccaagcuauacgacaaugacagacuaacuugguacgaggaaggcggagccgaacuauucgcaggcuccacacgcaccucaggaauacucccucgcaaaagcauaguauccaacauacacaacaccacccgaaacaacagauauaaacuaagcgacaccguccacagcaaauacggagcgagcuucgaguucuacaacuacgccugcauguuuauggacuauauguacaacaaagauaugggcauacucaacaaacuuaacgaccuagcaaagaacaacgacgucgacggcuacgacaacuacauacgggaccucagcucgaacuaugcacuaaacgacaaauaccaagaccacaugcaggaacgcauagacaacuacgaaaaccucaccguacccuucgucgcagacgacuaccuaguccgacacgcguacaaaaaucccaacgaaaucuacuccgaaaucagcgaagucgccaagcugaaggaugccaaaagcgaagugaagaaaucacaauauuucucaaccuucacgcuccgcggcucauacacagguggcgccuccaaaggaaaacuagaggaucaaaaagcaaugaacaaguucauagacgacucccucaaaaagcucgacacauacuccugguccggcuacaaaacacuuaccgcguacuucaccaacuacaaaguagacuccucgaaucgaguaaccuacgacgucguauuccacggcuaccuuccaaacgaaggcgacuccaaaaacucccuacccuacggaaagauaaacggcaccuacaaagguaccgaaaaggagaaaaucaaauucuccagcgaagggucauuugacccagacggaaaaaucgucuccuacgaaugggacuucggagacggaaauaagucaaacgaagaaaaccccgaacacagcuacgacaaagugggaaccuacaccguaaagcucaaagugacagaugacaaaggcgaaucaaguguaaguacgaccacugcugagauaaaagacuugucggagaauaaacuucccguaaucuacaugcacguccccaaaucaggagcacuaaaccagaaagucguauucuacggcaaaggaaccuacgaccccgacggcucaauagccggauaucaaugggauuucggggacggaagcgacuuuucgucggaacagaaccccagccacguguacacgaagaaaggggaauacaccgucacccugcggguaauggacagcucaggccaaauguccgagaaaacaaugaaaauaaaaaucaccgaccccgucuaccccaucggcacggaaaaagaacccaacaacuccaaagaaaccgcauccggcccaaucgugcccggcauacccgucuccggcacaauagaaaauaccuccgaccaagacuacuucuauuucgaugucaucacccccggagaggucaaaaucgacaucaacaaacugggcuacggcggagcaaccuggguagucuacgacgagaacaacaacgccgucaguuacgcaaccgacgacgggcaaaaccucagcggaaaguucaaagccgacaaaccaggaagauacuacauccaccuauacauguucaauggcagcuacaugcccuacagaauuaauaucgagggauccgugggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4647 - RNA, 3413 nt, Artificial Sequence
  mRNA product Design3 comprising derived and/or modified sequence from Clostridium histolyticum__BAA34542.1__ColH (opt9)
gggagagucccgcagucggcguccagcggcucugcuuguucgugugugugucguugcaggccuuauucaagcuuaccaugaaacgaaaaugccuuagcaaacgccugaugcucgccauuaccauggcgacaauauucaccgugaacaguacgcucccuaucuacgcagccguagacaaaaacaacgcaaccgcagccguacagaacgaguccaaacgcuacaccgucuccuaucucaagacccuaaacuacuacgaccuuguagaccuccucgugaagaccgaaaucgaaaaccuacccgaccucuuccaauacuccagcgacgccaaggaguucuacggaaacaaaacccgaaugagcuucauaauggacgaaaucggucgccgcgcgccccaauacacggaaaucgaccauaaaggaaucccuaccuuagucgaggucguaagagcggguuucuaccuaggauuccacaacaaagagcuaaacgagaucaacaaacgcuccuucaaagaacgcgugauccccucuauccuagccauccagaaaaacccaaauuucaaacucggcaccgaaguacaagauaaaauaguaagcgccaccggacuccucgcuggcaacgaaaccgcacccccagaaguagugaauaacuucacacccauccuccaagauugcaucaaaaauauagaccgauacgcccuggacgauuuaaaaagcaaagcacucuucaacguacucgcugcacccacauacgacaucacagaguacuugagggcaacgaaagagaaacccgaaaacacccccugguacggaaaaauagacggcuucaucaacgaacuaaagaaauuggcgcuauaugggaaaaucaacgacaacaacaguuggauaaucgacaacggcaucuaucacauagcaccccucggcaaacuccauagcaacaacaaaauaggcauagaaacacuaacugaagucaugaaaguauaccccuaucucagcaugcaacaccuacaauccgccgaccaaaucaaacgccacuacgacagcaaagacgcagaaggcaacaaaauaccccucgacaaguucaagaaagaaggaaaagagaaauacugccccaaaaccuacaccuucgacgacggcaaaguaaucaucaaggccggagcacgaguagaagaagagaaaguaaaacgacucuacugggcgagcaaagaagucaauagccaauucuuccgcguuuacgguaucgauaaaccgcuugaagaaggcaacccagaugacauccuaacgaugguuaucuauaacagucccgaagaauacaaacucaacagcguccuuuauggguacgacaccaauaacggcgggauguacaucgaacccgaggggaccuucuucacauacgaacgagaagcccaagaauccaccuacacacuagaagaacucuuccgccacgaauacacccacuaucuucagggcagauacgccguaccaggacaaugggggaggaccaaauuauacgacaacgaccgacucacaugguacgaagaaggcggcgccgaguuauucgcuggaaguacucgaaccuccggcauccuuccccgaaaaagcauagucucgaacauccacaacacaacccguaacaaucgcuacaaacuauccgauacaguccacagcaaauauggagcuagcuuugaguucuacaacuaugccugcauguucauggacuacauguacaacaaggacaugggcauccucaacaaacuaaacgaccuggcgaaaaacaacgacguagacggcuacgacaacuacauacgcgaucuuagcucuaacuacgcccuaaacgacaaauaucaagaccauaugcaggaacggaucgauaauuacgaaaaucucacaguacccuucgucgccgacgacuaccuaguccggcaugcauacaaaaacccgaaugagauauacuccgagaucucagaagucgcaaaacugaaagacgcaaagucggaaguuaaaaagagccaauacuucagcacauucacccuccgcggaucuuacaccggcggggccuccaaggggaaacuugaggaccaaaaagcaaugaacaaauuuaucgacgacagccucaaaaagcucgacaccuacagcuggagcggguacaaaacacuuacggcauacuucaccaauuacaaagucgacucgagcaaucgggucaccuacgacguggucuuccacggcuaccuaccgaacgaaggcgacagcaaaaacucacuaccguacggcaaaauaaacggcacguauaaagggaccgaaaaagaaaagaucaaguucucaucagaaggcuccuucgacccagacggaaaaauagugagcuaugagugggauuucggcgacgggaacaaaucaaacgaagagaacccggagcacagcuacgacaaagucgggaccuacaccgucaaacuaaaagucaccgaugacaaaggcgaguccucaguauccacgaccacggcugaaaucaaagaccugagcgaaaacaagcucccagucauauacaugcacgucccgaaauccggcgcccuaaaccagaaagucgucuucuacggcaaaggcacuuacgacccagacggcagcauagcaggauaccaaugggacuucggggacggcuccgacuucucaucagaacagaacccaucacacgucuacaccaaaaagggcgaguacacaguuacacuccgcgugauggacuccuccggacaaaugagcgagaaaacaaugaaaauaaaaauaaccgacccgguauacccaauaggcacggaaaaggaaccuaacaacagcaaagaaacagcaucaggucccauuguacccggcaucccagucucaggaaccaucgaaaacaccuccgaccaagacuacuucuacuucgauguaauaacacccggcgaaguaaaaaucgacaucaacaaacucggguacgggggagcaaccugggucguauacgaugaaaacaacaacgcugucucauacgcaaccgacgacggacagaaccugagcggcaaguucaaagccgacaaaccagggagguacuacauacaccucuacauguucaaugguagcuacaugccuuaccguauaaauaucgaaggaucuguaggacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4648 - RNA, 3347 nt, Artificial Sequence
  mRNA product Design3 comprising derived and/or modified sequence from Clostridium histolyticum__BAA34542.1__HsALB(1-18)_ColH(41-1021) (opt9)
gggagagucccgcagucggcguccagcggcucugcuuguucgugugugugucguugcaggccuuauucaagcuuaccaugaaaugggugaccuucauaagccuucucuuccucuucucauccgccuacagcguacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4649 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt9)
gggagagucccgcagucggcguccagcggcucugcuuguucgugugugugucguugcaggccuuauucaagcuuaccaugaaaugggucaccuucaucucucuacuguuccucuucucuagcgcauauagcaugaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4650 - RNA, 923 nt, Artificial Sequence
  mRNA product Design3 comprising derived and/or modified sequence from Homo sapiens__NP_001133.1__HsAMELX (opt9)
gggagagucccgcagucggcguccagcggcucugcuuguucgugugugugucguugcaggccuuauucaagcuuaccaugggaacauggauacucuucgcaugccuccucggcgcagccuucgccaugccccucccuccccaccccggccaccccggcuacaucaacuucuccuacgaaguccucacaccccucaaaugguaucaauccaucagaccacccuaccccuccuacggcuacgaacccaugggcggcuggcuccaccaccaaaucauccccguccucucacaacaacacccucccacccacacccuccaaccccaccaccacauccccguaguccccgcccaacaacccgucaucccccaacaacccaugaugcccguccccggccaacacucaaugacccccauccaacaccaccaacccaaccucccaccacccgcccaacaacccuaccaaccccaacccguccaaccccaaccccaccaacccaugcaaccccaaccacccguacaccccaugcaaccccucccaccccaaccaccccuaccucccauguuccccaugcaaccccucccacccaugcuccccgaccucacccucgaagccuggcccuccaccgacaaaaccaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4651 - RNA, 482 nt, Artificial Sequence
  mRNA product Design3 comprising derived and/or modified sequence from Homo sapiens__NP_001133.1__HsAMELX-TRAP (opt9)
gggagagucccgcagucggcguccagcggcucugcuuguucgugugugugucguugcaggccuuauucaagcuuaccaugccccuacccccccacccaggccaccccggcuacauaaacuucuccuacgaaguacucacaccccuaaaaugguaccaauccauccgaccccccuaccccucauacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4652 - RNA, 515 nt, Artificial Sequence
  mRNA product Design3 comprising derived and/or modified sequence from Homo sapiens__NP_001133.1__HsAMELX-LRAP (opt9)
gggagagucccgcagucggcguccagcggcucugcuuguucgugugugugucguugcaggccuuauucaagcuuaccaugccccuccccccccaccccggccaccccggcuacauaaacuucucauacgaaguccucaccccccuaaaaugguaccaauccauccgccccccccccaugcuccccgaccucacacucgaagccuggcccucaaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4653 - RNA, 554 nt, Artificial Sequence
  mRNA product Design3 comprising derived and/or modified sequence from Homo sapiens__NP_001133.1__HLA-A2-SP_HsAMELX(17-60) (opt9)
gggagagucccgcagucggcguccagcggcucugcuuguucgugugugugucguugcaggccuuauucaagcuuaccauggccguaauggccccccgaacccucguccuccuacucucaggagcccucgcccucacccaaaccugggccaugccccucccaccccacccaggccaccccggauacaucaacuucuccuacgaaguacucaccccccuaaaaugguaccaauccauccgcccccccuaccccucauacggcuacgaacccaugggcggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4654 - RNA, 587 nt, Artificial Sequence
  mRNA product Design3 comprising derived and/or modified sequence from Homo sapiens__NP_001133.1__HLA-A2-SP_HsAMELX(17-47,168-191) (opt9)
gggagagucccgcagucggcguccagcggcucugcuuguucgugugugugucguugcaggccuuauucaagcuuaccauggccguaauggcaccccgcacccucguccuacuccuauccggcgcccucgcccucacacaaaccugggccaugccccucccaccccaccccggccaccccggcuacauaaacuucuccuacgaaguccucaccccacucaaaugguaccaauccauccgcccaccacccaugcuacccgaccucacacucgaagccuggcccuccaccgacaaaacaaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4655 - RNA, 926 nt, Artificial Sequence
  mRNA product Design3 comprising derived and/or modified sequence from Homo sapiens__NP_001134.1__HsAMELY (opt9)
gggagagucccgcagucggcguccagcggcucugcuuguucgugugugugucguugcaggccuuauucaagcuuaccaugggcaccuggauccucuucgccugccuagucggcgccgccuucgccaugccccucccaccccaccccggccaccccggcuacaucaacuucuccuacgaaguccuaacaccccuaaaaugguaccaauccaugauccgcccacccuacuccuccuacggcuacgaacccaugggcggauggcuccaccaccaaaucauccccgucgucucccaacaacacccccucacccacacccuccaaucacaccaccacauccccguaguccccgcccaacaaccccgcguacgacaacaagcccucaugcccguccccggccaacaauccaugacccccacccaacaccaccaacccaaccucccacuccccgcacaacaacccuuccaaccccaacccguccaaccccaaccccaccaaccaaugcaaccccaaccacccguccaacccaugcaaccccucuuaccccaaccaccccuaccacccauguucccccuccgcccccuaccacccauccuccccgaccuccaccucgaagccuggcccgccaccgacaaaacaaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4656 - RNA, 485 nt, Artificial Sequence
  mRNA product Design3 comprising derived and/or modified sequence from Homo sapiens__NP_001134.1__HsAMELY-TRAP (opt9)
gggagagucccgcagucggcguccagcggcucugcuuguucgugugugugucguugcaggccuuauucaagcuuaccaugccccuaccaccccacccaggccaccccggcuacaucaacuucucauacgaaguccucaccccccuaaaaugguaccaaucaaugauccgccccccauacucauccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4657 - RNA, 518 nt, Artificial Sequence
  mRNA product Design3 comprising derived and/or modified sequence from Homo sapiens__NP_001134.1__HsAMELY-LRAP (opt9)
gggagagucccgcagucggcguccagcggcucugcuuguucgugugugugucguugcaggccuuauucaagcuuaccaugccccuccccccccacccaggccaccccggcuacaucaacuucuccuacgaaguacucaccccccuaaaaugguaccaauccaugauccgccccccccccauacuccccgaccuccaccucgaagccuggcccgccacagacaaaaccaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4658 - RNA, 557 nt, Artificial Sequence
  mRNA product Design3 comprising derived and/or modified sequence from Homo sapiens__NP_001134.1__HLA-A2-SP_HsAMELY(17-61) (opt9)
gggagagucccgcagucggcguccagcggcucugcuuguucgugugugugucguugcaggccuuauucaagcuuaccauggcagucauggcaccccgcacccucguccuccuccucuccggcgcccucgcccuaacccaaaccugggcaaugccacuacccccacaccccggccaccccggcuacaucaacuucucauacgaaguccuaacaccccucaaaugguaccaaucaaugauccgcccacccuacuccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4659 - RNA, 590 nt, Artificial Sequence
  mRNA product Design3 comprising derived and/or modified sequence from Homo sapiens__NP_001134.1__HLA-A2-SP_HsAMELY(17-48,169-192) (opt9)
gggagagucccgcagucggcguccagcggcucugcuuguucgugugugugucguugcaggccuuauucaagcuuaccauggccgucauggcaccccgaacacucguccuccuccucuccggcgcccucgcccucacacaaacaugggccaugccccucccaccccaccccggccaccccggcuacaucaacuucuccuacgaaguccucacaccccuaaaaugguaccaauccaugauccgcccacccccaauacuccccgaccuacaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4660 - RNA, 917 nt, Artificial Sequence
  mRNA product Design3 comprising derived and/or modified sequence from Sus scrofa__NP_999071.1__SsAMELX-001-1 (opt9)
gggagagucccgcagucggcguccagcggcucugcuuguucgugugugugucguugcaggccuuauucaagcuuaccaugggcaccuggauacucuucgccugccuccucggcgccgccuucuccaugccccuaccaccccaccccggacaccccggcuacaucaacuucuccuacgaaguccuaacaccccucaaaugguaccaaaauaugauacgccaccccuacacauccuacggcuacgaacccaugggcggauggcuccaccaccaaaucauccccgucgucucacaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuacccgcccaacaacccuuccaaccccaacccguacaaccccaaccccaccaaccccuucaaccccaaucucccaugcaccccauccaaccccuccucccccaaccaccccuuccacccauguucucaaugcaaucacuccuccccgaccucccccucgaagccuggcccgccaccgacaaaaccaaacgagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4661 - RNA, 485 nt, Artificial Sequence
  mRNA product Design3 comprising derived and/or modified sequence from Sus scrofa__NP_999071.1__SsAMELX-TRAP (opt9)
gggagagucccgcagucggcguccagcggcucugcuuguucgugugugugucguugcaggccuuauucaagcuuaccaugccccuaccaccccaccccggccaccccggcuacaucaacuucuccuacgaaguccuaacaccccuaaaaugguaccaaaacaugauccgccacccauacaccucauacggcuacgaaccaaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4662 - RNA, 518 nt, Artificial Sequence
  mRNA product Design3 comprising derived and/or modified sequence from Sus scrofa__NP_999071.1__SsAMELX-LRAP (opt9)
gggagagucccgcagucggcguccagcggcucugcuuguucgugugugugucguugcaggccuuauucaagcuuaccaugccccucccaccccaccccggccaccccggcuacaucaacuucuccuacgaaguccuaacaccccucaaaugguaccaaaacaugauccgacaccccucccuacuccccgaccucccccuagaagcauggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4663 - RNA, 557 nt, Artificial Sequence
  mRNA product Design3 comprising derived and/or modified sequence from Sus scrofa__NP_999071.1__HLA-A2-SP_SsAMEL(17-61) (opt9)
gggagagucccgcagucggcguccagcggcucugcuuguucgugugugugucguugcaggccuuauucaagcuuaccauggccgucauggcaccccgcacccuaguccuccuccucucaggcgcccucgcacucacccaaacaugggccaugccccuacccccacaccccggccacccaggcuacaucaacuucucauacgaaguccucaccccacuaaaaugguaccaaaacaugauacgccaccccuacaccucauacggauacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4664 - RNA, 590 nt, Artificial Sequence
  mRNA product Design3 comprising derived and/or modified sequence from Sus scrofa__NP_999071.1__HLA-A2-SP_SsAMEL(17-49,167-189) (opt9)
gggagagucccgcagucggcguccagcggcucugcuuguucgugugugugucguugcaggccuuauucaagcuuaccauggccgucauggcaccccgcacucucguccuccuacucuccggcgcccuagcccucacccaaaccugggccaugccccuacccccacaccccggccaccccggcuacaucaacuucucauacgaaguccucaccccacuaaaaugguaccaaaacaugauccgccaucccucacuccuccccgaccucccccuagaagccuggcccgccacagacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4665 - RNA, 881 nt, Artificial Sequence
  mRNA product Design3 comprising derived and/or modified sequence from Sus scrofa__P45561-2__SsAMELX-001-2 (opt9)
gggagagucccgcagucggcguccagcggcucugcuuguucgugugugugucguugcaggccuuauucaagcuuaccaugggcaccuggauacucuucgccugccuccucggcgcagccuucuccaugccccucccaccccaccccggccaccccggcuacaucaacuucucuuacauccgccaccccuacaccuccuacggcuacgaacccaugggcggcuggcuacaccaccaaaucauccccgucguaucccaacaaaccccacaaucacacgcucuccaaccccaccaccacauccccaugguccccgcccaacaacccggcaucccccaacaacccaugaugccccuccccggccaacacuccaugacccccacccaacaccaccaacccaaccucccccucccagcccaacaacccuuccaaccccaacccguccaaccccaaccacaccaaccacuacaaccacaaucccccaugcaccccauccaaccacuccucccccaaccaccccucccacccauguucucaaugcaaucccuccuacccgaccuuccccuugaagccuggcccgccaccgacaaaaccaaacgagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4666 - RNA, 917 nt, Artificial Sequence
  mRNA product Design3 comprising derived and/or modified sequence from Sus scrofa__NP_998965.1__SsAMELX-001-3 (opt9)
gggagagucccgcagucggcguccagcggcucugcuuguucgugugugugucguugcaggccuuauucaagcuuaccaugggcaccuggaucuucuucgcaugccuccuaggcgccucccucgccaugccccucccaccccaccccggacaccccggcuacaucaacuucuccuacgaaguccucaccccacuaaaaugguaccaaaacaugauccgccaccccuacaccuccuacggauacgaacccaugggaggcuggcuccaccaccaaaucauccccgucgucucacaacaaacaccccaaucccacgcacuccaaccccaccaccacauccccaugguccccgcccaacaacccggaaucccccaacaacccaugaugccccuccccggacaacacuccaugacccccacccaacaccaccaaccaaaccucccccuccccgcccaacaacccuuccaaccacaacccguccaaccccaaccccaccaaccacuccaaccccaaucccccaugcaccccauccaaccacuccucccccaaccaccccucccacccauguucucaaugcaaucccuccuucccgaccucccccucgaagccuggcccgccaccgacaaaaccaaacgcgaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4667 - RNA, 566 nt, Artificial Sequence
  mRNA product Design3 comprising derived and/or modified sequence from Sus scrofa__K7GPB2__SsAMELX-002 (opt9)
gggagagucccgcagucggcguccagcggcucugcuuguucgugugugugucguugcaggccuuauucaagcuuaccaugggcaccuggauacucuucgccugccuacucggcgccgcauucucaaugccccuccccccccaccccggccaccccggcuacauaaacuucuccuacgaaguccucaccccccucaaaugguaccaaaacaugauuagacacccaucccuccuccccgaccucccccucgaagcauggcccgcaaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4668 - RNA, 959 nt, Artificial Sequence
  mRNA product Design3 comprising derived and/or modified sequence from Sus scrofa__K7GLD0__SsAMELX-003 (opt9)
gggagagucccgcagucggcguccagcggcucugcuuguucgugugugugucguugcaggccuuauucaagcuuaccaugggcacauggauccucuucgccugccuacucggagccgcuuuuuccaugccccucccuccccaccccggccaccccggcuacauaaacuucuccuacgaagaccucuaccucgaagccauccgcaucgaccgcaccgccuucguccucacaccccuuaaaugguaccaaaacaugauccgccaccccuacaccuccuacggcuacgaacccaugggcgguuggcuccaccaccaaaucauccccguagucucacaacaaaccccacaaucccacgcccuccaaccccaccaccacauaccaaugguccccgcccaacaaccaggcaucccccaacaacccaugaugccccuccccggccaacacuccaugaccccaacccaacaccaccaacccaaccucccccuccccgcccaacaacccuuccaaccccaacccguccaaccccaaccccaccaaccccuccaaccccaaucccccaugcaccccauccaaccucuccucccccaacccccacucccaccaauguucucaaugcaaucacuccuccccgacuuaccccuagaagccuggcccgccaccgacaaaaccaaacgagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4669 - RNA, 845 nt, Artificial Sequence
  mRNA product Design3 comprising derived and/or modified sequence from Sus scrofa__K7GPE9__SsAMELX-004 (opt9)
gggagagucccgcagucggcguccagcggcucugcuuguucgugugugugucguugcaggccuuauucaagcuuaccaugggcaccuggauccucuucgccugccuccucggcgccgccuucuccaugccccucccaccccaccccggccaccccggcuacaucaacuucucauaugaaguccucacaccccucaaaugguaccaaaacaugauccgccaccccacaccccaaucccacgcccuccaaccacaccaccacauccccaugguccccgcccaacaaccaggcaucccacaacaacccaugaugccccuaccaggccaacacuccaugacccccacccaacaccaccaacccaaccuaccccuccccgcacaacaacccuuccaaccacaacccguccaaccccaaccccaccaaccccuacaaccccaaucccccaugcacccaauccaaccccuccucccccaaccaccccucccacccauguucuccaugcaaucacuccuccccgaccucccccuagaagccuggcccgcaaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4670 - RNA, 869 nt, Artificial Sequence
  mRNA product Design3 comprising derived and/or modified sequence from Sus scrofa__J9JIM4__SsAMELX-201 (opt9)
gggagagucccgcagucggcguccagcggcucugcuuguucgugugugugucguugcaggccuuauucaagcuuaccaugccccucccaccccaccccggccaccccggcuacaucaacuucuccuacgaaguacucaccccucucaaaugguaccaaaacaugauccgacaccccuacaccuccuacggcuacgaacccaugggcggcuggcuccaccaccaaaucauccccgucgucucccaacaaacaccccaaucccacgcacuacaaccccaccaccacauccccaugguccccgcccaacaacccggcaucccccaacaacccaugaugccacuccccggccaacacuccaugacccccacccaacaccaccaacccaaccucccccuacccgcccaacaacccuuccaaccccaacccguccaaccacaaccucaccaaccacuccaaccccaaucacccaugcaccccauccaaccacuccuaccccaacccccacucccacccauguucuccaugcaaucacuccuccccgaccucccccuagaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4671 - RNA, 3308 nt, Artificial Sequence
  mRNA product Design3 comprising derived and/or modified sequence from Homo sapiens__NP_006120.1__HsBMP1 (opt9)
gggagagucccgcagucggcguccagcggcucugcuuguucgugugugugucguugcaggccuuauucaagcuuaccaugccaggagucgcccggcuaccccuacuccuaggacuccuccuacuaccacgcccuggacgaccccuagaccuggccgacuacacguacgaccuagccgaagaagacgacuccgaaccccucaacuacaaagaccccugcaaggccgccgccuuccuaggcgacauagcccuagacgaagaagaccuccgagccuuccaaguccaacaagcggucgaccugcgccgacacacggccaggaaaucauccauaaaagccgcuguaccgggaaacacaucaacccccucaugccaaucgacaaacggacaaccacaaaggggcgcaugcggaagauggcgcgggcgaucacgcucacgccgcgcagccacaagccgcccggagcgaguguggcccgacgggguaauacccuucgucauagggggaaacuucacuggaucacaacgggcagucuuuagacaagcaaugagacacugggaaaagcauaccugcgucacauuccuagaacggaccgacgaagauucauacaucguauucaccuaccgcccaugcggauguugcucauacguaggccgaagaggcggcggcccccaagcgauaucgauaggcaagaacugcgacaaauucgggauaguuguacacgaacuaggacacgucguaggcuucuggcacgaacacaccagacccgaccgggaccggcacguauccauaguccgcgaaaacauccaacccggacaagaauacaacuuccuaaaaauggaaccacaagaagucgaaucgcuaggcgaaaccuaugacuucgauuccaucaugcacuaugcucgcaacaccuucucacgaggcaucuuccucgacaccaucguccccaaauacgaaguuaacggagucaaaccacccauaggacaacgcacgcgacucucaaaaggcgauaucgcucaagcacgcaaacucuacaagugucccgccugcggcgaaacgcuccaggacucgacaggcaacuucucaucccccgaauacccgaacggauacagcgcacacaugcacugugucuggcgaaucucaguaacaccaggcgagaaaaucauccuuaacuucacaucccucgaccuguacagaucccgccucugcugguacgauuacgucgaagucagagacggguucuggcgaaaagcaccgcuccgaggccgauucuguggauccaaacugccagaacccauagucuccacagacucucgacucuggguugaguucagaagcucuaguaacugggucggcaaaggcuucuucgccgucuacgaagcaaucugcggaggagacguaaagaaagauuacggccacauacagucccccaacuaccccgacgacuaccggcccaguaaaguauguaucuggagaauccagguaagcgaaggcuuccauguugggcucaccuuucagagcuucgaaauagaacgccacgacucaugcgcuuaugacuaucucgaaguacgcgacggccacuccgaaucaagcacacucauaggcagauacugcggauacgaaaaacccgaugacaucaaauccacguccagccgccuauggcucaaauucgucucagauggaagcauaaacaaagccggauuugcuguuaacuucuucaaggaaguagacgagugcucccgacccaaccgcggcgggugcgaacaacgcugccucaacacacucgguuccuacaaaugcagcugcgacccaggcuacgaacuagccccugauaagcgucgcugcgaagcagccugcgguggguuccucacaaaacuaaacggauccauaacaagcccuggcuggccaaaagaauaucccccuaacaagaacugcaucuggcaacugguggcgcccacacaauaccgaauaagccuacaauuugacuucuucgagacagaaggaaaugacgugugcaaguacgacuucguagaaguccgcuccggguuaaccgccgacuccaagcugcaugggaaauucugcggauccgaaaaaccagaagugauuacgagccaauacaacaacaugcgagucgaguucaagucagacaacacagucuccaagaaaggcuuuaaagcucacuucuucucagacaaagacgagugcucaaaagacaauggagggugucaacaagacugcguuaacacauucggguccuacgaaugccaaugccgcucuggguucguacuucacgauaacaagcacgacugcaaagaagccggaugcgaccacaaggugacaagcaccuccggcaccauaacgucccccaacuggccagauaaauaccccucaaagaaagaaugcacgugggccaucaguagcacucccggccacagagucaaacucacauucauggaaauggacaucgaaagccagccggagugcgcguacgaccaccucgaaguguucgacggacgcgacgcgaaggcuccagugcucggccgauucugcggauccaagaagccagaaccagucuuagcaacuggaagccgaauguuccuacgauucuacuccgacaauuccguucaacgaaaaggcuuccaagccucccacgccaccgaaugcggcggacaaguccgagcggacguaaaaaccaaagaccucuacagccacgcgcaauucggggacaacaacuacccagguggcguagacugcgaauggguaauagucgcagaagaaggcuacggagucgagcuaguauuccagaccuucgaaguugaagaagaaacagacugcggcuacgacuacauggaacuauucgacgguuacgacuccaccgcaccccggcucggacgguacugcggcuccggcccaccagaagaaguauacucagcaggagacagcguccucgucaaauuccacuccgaugauaccauaacaaagaaaggguuucaccuacgcuacacgagcaccaaauuccaagacacucuacacagccgcaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4672 - RNA, 1538 nt, Artificial Sequence
  mRNA product Design3 comprising derived and/or modified sequence from Homo sapiens__NP_001191.1__HsBMP2 (opt9)
gggagagucccgcagucggcguccagcggcucugcuuguucgugugugugucguugcaggccuuauucaagcuuaccaugguagccggcacccgaugccuacucgcccuccuucucccccaaguccuccuaggcggcgccgccggccuggucccagaacuaggccgccgcaaauucgcagccgcauccuccggacgcccaucaucacagcccuccgacgaaguccucuccgaguucgaacucagacuacuaucgauguucggccuuaaacaacgccccaccccaucccgugacgccguagucccaccauacaugcucgaccuauaccgccgccacuccgggcaacccggaucaccagcacccgaccaccgccucgaacgcgccgcaucccgcgccaacacaguccgcuccuuccaccacgaagaaucccucgaagaacuccccgaaacaucaggcaaaacaacccgccgauucuucuucaaccucuccuccauacccacagaagaguucaucaccuccgcagaauuacaagucuuccgcgaacaaaugcaagacgcacucggcaacaacuccuccuuccaccacagaaucaacaucuacgaaaucaucaaacccgcaaccgccaacagcaaauucccaguaacccgacuccuugacacacgacucgucaaccaaaacgccuccagaugggaaucauucgacgucacaccagcagucaugcgcuggaccgcccaaggccacgcaaaccauggauucgugguagaagucgcccaccuagaagaaaaacaaggagucuccaaacgccacguccgcaucucacgcucccuccaccaagacgaacacucauggucacaaauccgaccccuccuaguaacauucggacacgacggcaaaggccacccccuacauaaacgcgaaaaacgacaagccaaacauaagcaacgaaaacgccucaaaucaagcuguaaacgucauccacucuacgucgacuucucugacgucggcuggaacgacuggaucguagcaccacccggcuaccacgccuuuuacugccacggagaaugccccuucccccucgccgaccaccuaaauuccaccaaccacgcaauaguccaaacccuaguuaacuccgucaacuccaaaaucccaaaagcaugcugcguucccacagaacucucagcaaucuccaugcucuaccuugacgaaaacgaaaaagucguccugaaaaacuaccaagacauggucgucgaaggcugcggcugccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4673 - RNA, 1574 nt, Artificial Sequence
  mRNA product Design3 comprising derived and/or modified sequence from Homo sapiens__NP_001193.2__HsBMP4 (opt9)
gggagagucccgcagucggcguccagcggcucugcuuguucgugugugugucguugcaggccuuauucaagcuuaccaugauacccggcaaccguaugcucauggucguccuccucugccaaguacuccucggcggagccucacacgcaucucucauacccgaaacuggcaaaaaaaaagucgccgaaauccaaggccacgcaggaggacgccgcucaggucaaucccacgaacuccuacgcgacuucgaagccacccuacuacaaauguucggccuccgacgccgaccccagcccuccaaauccgccgucauacccgacuacaugcgcgaccucuaccgacuucaauccggcgaagaagaagaagaacaaauacacagcaccggccucgaauaccccgaacguccagccucccgcgccaacaccguccgcucuuuccaccacgaagaacaccucgaaaacauccccggcacauccgaaaacuccgccuuccgauuccucuucaaccuauccucaauccccgaaaacgaagucauauccuccgccgaacuccgucucuuccgcgaacaaguagaccaaggccccgauugggaacgcggcuuccaccgcaucaauaucuacgaagucaugaaaccaccagccgaagucguacccggacaccucaucacacgcuuacuagacacccgccucguccaccacaacguaacacgcugggaaaccuucgacgucuccccagcuguucuccgauggacacgcgaaaaacaacccaacuacggccucgccaucgaagucacccaccuccaccaaacccgaacccaccaaggccaacacgucagaaucucccgcucucucccccaaggcucaggcaacugggcccaacuacgcccccuacuugucaccuucggccacgacggacgaggccacgcacuaacgcgacgccgccgcgccaaacgcucacccaaacaccacucucagcgcgccagaaaaaaaaacaaaaauugccgccgacacucacuguacgucgacuucagcgacgucggcuggaaugacuggaucgucgccccccccggcuaccaagcauucuacugccacggcgacugcccauucccacuagcugaccaccucaacucgaccaaccacgcaauuguacaaacccucgucaauuccgucaacagcuccaucccaaaagcaugcugcgugcccaccgaacucuccgcuaucuccaugcucuaccucgacgaauacgacaaagucguacucaaaaacuaccaagaaauggucgucgaaggaugcggcugccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4674 - RNA, 1889 nt, Artificial Sequence
  mRNA product Design3 comprising derived and/or modified sequence from Homo sapiens__NP_001709.1__HsBMP6 (opt9)
gggagagucccgcagucggcguccagcggcucugcuuguucgugugugugucguugcaggccuuauucaagcuuaccaugcccggucuaggccgccgcgcacaguggcucugcuggugguggggacuacucugcuccugcugcggcccuccccccuuacguccacccuuaccagcagccgccgccgcggcagcaggaggccaacuacucggcgacgguggcucccccggacgaacggaacaacccccccccucaccccaauccucaagcggcuuccucuaccgccgccucaaaacccaagaaaaacgagaaaugcaaaaagaaauacuauccguccuaggccuuccacaccggccccgcccacuccacggccugcaacaaccccagccacccgcccuccgccaacaagaagaacaacaacaacaacaacaacucccccggggugaacccccuccaggccgccuaaaaucugccccucucuucaugcucgaccucuacaaugcccuauccgccgauaacgacgaagauggagcgucagaaggagaacgccaacaaucauggccccacgaagccgccuccucaucccaacgccgacaacccccgcccggcgccgcccacccccuaaaccguaaaucccugcucgcccccggcucaggcagcgguggugcauccccacucaccucggcccaagacuccgcauuccuaaacgacgcagacauggucaugagcuucgucaaccuagucgaauacgacaaagaauucuccccacgccaacgacaccauaaagaauucaaauucaaccucucacagauacccgaaggagaagucgucaccgccgcagaauuccgaaucuacaaagacugcguaauggguagcuucaaaaaccaaacauuccuaaucucuauauaccaaguacuccaagaacaccaacaccgugacagugaccuauuccuccucgacacccgagucguuugggccucagaagaaggcuggcucgaauucgacaucacagcaaccagcaaccuauggguaguaacaccgcaacacaacaugggccuacaacuauccguagucacccgagacggaguacacguucacccgcgcgcagccggccucguaggacgcgacggccccuacgacaaacagcccuucauggucgccuucuucaaagucuccgaaguacacguccgcaccacccgcuccgccuccucucgacgccgccaacaaucccgaaaccgauccacccaaucccaagacgucgcccgcguuuccucugccucagacuacaauuccucagaacucaaaaccgccugccgaaaacacgaacuauauguaucauuccaagaccuuggcuggcaagacuggaucaucgcccccaaaggcuacgcagccaacuacugcgacggcgaaugcuccuucccacuaaacgcccacaugaacgccaccaaccacgccaucguccaaacacucgugcaccuuaugaaccccgaauacguacccaaaccaugcugcgcccccaccaaacuaaacgccaucuccguacucuacuucgaugacaacuccaacgucauacuaaaaaaauaccguaacaugguaguacgcgccugcgguugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4675 - RNA, 1643 nt, Artificial Sequence
  mRNA product Design3 comprising derived and/or modified sequence from Homo sapiens__NP_001710.1__HsBMP7 (opt9)
gggagagucccgcagucggcguccagcggcucugcuuguucgugugugugucguugcaggccuuauucaagcuuaccaugcacgugcguucacuacgagcagccgccccacacucauucgucgcccucugggcuccccuuuuucuccuacgcucugcccucgccgacuucucccuagacaacgaaguacacagcucauucauccaccgccgucuccgcucucaagaaagacgcgaaaugcaacgugaaauccucuccauccucggccucccccaccgaccccgcccccaccuacaaggcaaacacaacuccgcccccauguucaugcucgaccucuacaacgccauggccguagaagaaggaggaggacccgguggccaaggcuucuccuaccccuacaaagccgucuuuuccacccaaggucccccgcucgcaucacuccaagacucccacuuccucaccgacgccgacauggucaugucauucgucaaccuugucgaacacgacaaagaguucuuccacccccgcuaccaccaucgcgaguuccgcuucgaccucagcaaaauucccgaaggcgaagccgucaccgccgccgaguuccgaaucuacaaagacuacauccgugaacgcuucgacaacgaaacuuuccgcaucucagucuaccaaguccuccaagaacaccuaggccgcgaaucagaccucuuucuccucgacucacgaacccucugggccucagaagaaggauggcucgucuucgacaucacagccacauccaaccacugggucgucaacccucgccacaaccuuggacuccaacuguccgucgaaacccucgacggccaauccauaaaccccaaacucgccggccucauaggccgacacggaccccaaaacaaacaaccauucauggucgcauuuuucaaagcaaccgaaguccacuuuagauccauccguuccaccggaucaaaacaacgcucccaaaaccgcuccaaaacccccaaaaaccaagaagcccuccgcauggccaacguagcagaaaacuccuccagcgaccaacgccaagccugcaaaaagcacgaacucuacguaucauuucgagaccucggcuggcaagacuggauaaucgccccagaaggcuacgccgcauacuacugcgaaggagaaugcgccuucccccuaaauuccuacaugaacgccaccaaccacgccaucguccaaacccucguccacuucaucaaccccgaaacugucccaaaacccugcugcgcccccacacaacuaaacgccaucucaguccucuacuuugacgacucaucuaacguaauccuaaagaaauaucgcaacaugguaguccgcgccugcgguugccacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4676 - RNA, 647 nt, Artificial Sequence
  mRNA product Design3 comprising derived and/or modified sequence from Homo sapiens__NP_006264.2__HsCCL7 (opt9)
gggagagucccgcagucggcguccagcggcucugcuuguucgugugugugucguugcaggccuuauucaagcuuaccaugaaagccuccgccgcccuccuaugccuccuccucaccgccgccgcauucuccccccaaggccucgcccaaccagucggcauaaacaccuccaccaccugcugcuaccgauucaucaacaaaaaaaucccaaaacaacgacucgaauccuaccgccgcaccaccuccucccacugcccccgagaagccgucaucuucaaaaccaaacucgacaaagaaaucugcgccgacccaacccaaaaauggguccaagacuucaugaaacaccuagacaaaaaaacccaaaccccaaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4677 - RNA, 3971 nt, Artificial Sequence
  mRNA product Design3 comprising derived and/or modified sequence from Homo sapiens__NP_001954.2__HsEGF (opt9)
gggagagucccgcagucggcguccagcggcucugcuuguucgugugugugucguugcaggccuuauucaagcuuaccaugcucuuaacccuuaucauacuucuucccgucgucagcaaguucagcuuugucucacucagugcaccccaacacuggagcugccccgaaggaacacuugccggcaacggcaauagcacaugcguugggccggcucccuuccuaauauucagccacggaaacagcauauuccgaaucgacacagagggaaccaacuacgaacagcugguagucgacgcuggcguaagcgucaucauggacuuccacuacaacgagaagcgaaucuacuggguagaucucgaacgccaacuacugcaacggguauucuugaacggcucgcgacaggagcgcgucugcaauaucgaaaagaacgucucaggaauggcuaucaacuggauuaaugaagaggugauauggagcaaccaacaggagggaaucauaaccgucacagacaugaaggguaacaacucccacauccuucucagcgcgcucaaauacccugcaaaugucgccguggauccugucgaacguuuuauauucuggucaagugaaguagccggcucccucuacagagccgaccucgacgguguaggggucaaggcacuacucgaaacguccgagaaaauaacagcaguaucgcuggacguacucgacaaacgccuauucuggauucaguacaaccgagaaggcagcaacuccuuaaucugcaguugcgacuacgacggagguagcgugcauauaaguaaacacccaacgcagcacaaccuauuugccaugucacuguucggggaccgcaucuucuacagcaccuggaaaaugaaaacaauauggaucgcaaacaaacacaccggcaaggauaugguccgcaucaaccuacacucuucauucguaccccuaggggagcucaaaguagugcacccucucgcccaaccaaaagcagaggaugauaccugggaacccgaacaaaagcugugcaaacuccgaaagggcaacugcucgagcaccgucugcggacaagaccugcaaagccaccucugcaugugugcggaaggauacgcacucucacgagaccggaaguacugcgaggacgucaacgaaugcgccuucuggaaccacggaugcacucuuggauguaagaacaccccaggauccuauuacuguaccugcccagucggauucguacuacuaccagacggaaaacgaugccaccaacugguauccugcccccgaaacguauccgaaugcucccacgauugcguccuaaccucagaggggccccucugcuucugcccagagggauccguguuagaacgcgacggcaagacuugcagcggcugcagcagcccagacaacggcgggugcagccaacuaugcguaccacuaucaccaguuucaugggaaugcgacugcuucccggguuacgaccuccagcucgacgaaaaaucaugugcggccagcggaccacagcccuuccuccuauucgccaauucacaagacauccggcacaugcacuucgacggcaccgacuacgguacccuacugagccaacaaauggguaugguguacgcgcucgaccacgacccaguagaaaacaaaauauacuucgcccacacagcccucaaguggaucgaacgagccaacauggauggaucacaacgcgagcggcuaauagaggaagguguggacgugccagaaggccuggccguagacuggauaggccgcagauucuauuggacagacagagguaaaucacucaucggacgaucagaccucaacggcaaaagguccaaaaucaucacuaaagagaacauaucacaaccacgcggcauagccguccaccccauggccaaacgccucuucuggaccgacacgggcaucaacccaagaauagaguccagcagccuccagggccuaggaagacuuguaaucgcaucguccgaucucauuuggcccagcgggaucacaaucgauuuccuaacugacaaacucuacuggugcgacgccaaacaaaguguaaucgaaauggcaaaccucgacggaucgaaacgacggcgccucacccaaaacgauguuggccaucccuucgcaguagcagucuuugaggacuacgucugguucagcgacugggccaugcccuccguaaugcggguuaacaaacgcaccggcaaagaccgaguccgacuacaggguuccaugcuuaaaccgagcucccuaguuguaguacacccacuagcaaaacccggggccgaccccugcuuauaucaaaacggaggaugcgaacacaucugcaagaaacgccucggcaccgcaugguguagcugccgagaaggauuuaugaaagccuccgacggcaaaaccugucuggcccuagauggccaccaacuccuugcgggcggcgaaguagaccuuaaaaaccaagugaccccgcuagacauacucucaaaaacgcgcgucucagaagacaacaucacagaaagccaacacaugcucguagcagaaaucaugguaagcgaccaagacgacugcgcacccguaggaugcagcauguaugcacggugcauaagcgaaggagaagacgcgaccugccaaugccuaaaaggauucgccggagacgguaagcucugcucagauauugacgaaugcgaaaugggaguacccguguguccacccgccagcucaaagugcaucaacacugaaggaggcuacgucugcagaugcagcgagggcuaucaaggcgacggcauccauugccuagauauagacgagugccagcuaggcgagcacucgugcggcgagaacgcgucgugcacaaacacggaagguggcuauacaugcaugugcgccggaagacucagcgaaccgggucuaauuugccccgacagcaccccaccuccacaccuucgcgaagacgaccaccacuacuccguccgcaacucggacucagaaugcccccucagucaugauggcuacugcuugcaugacggcguuuguauguauaucgaagcccuagacaaguacgcaugcaacugcgucguagguuacaucggagagcgcugccaauaucgcgaccuaaaauggugggaacucagacacgcaggucacggucagcaacaaaagguuaucgucguagccguuugugucgugguccuagucaugcuccuucuccuaucgcucuggggcgcccacuacuacagaacccaaaaacuccuauccaaaaacccgaaaaaucccuacgaagaaucgaguagggacguacguucgcgacgacccgcagacacggaagacggcaugaguucgugcccccaaccaugguucguaguuauuaaggaacaucaagauuugaaaaacggcggacagccagucgccggagaggacggccaagcagcagauggauccaugcaacccacaucauggagacaagaaccccaacuaugcggaaugggaacggaacaaggcugcuggauuccagucaguuccgacaaaggcucaugcccacaaguaauggaacgaucguuccacaugccauccuacggaacccaaacacucgaaggcgguguagaaaagccacacagccuccucucggcaaacccccuauggcagcagcgcgcacuagacccuccccaucaaauggagcugacccaauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4678 - RNA, 857 nt, Artificial Sequence
  mRNA product Design3 comprising derived and/or modified sequence from Homo sapiens__NP_001423.1__HsEREG (opt9)
gggagagucccgcagucggcguccagcggcucugcuuguucgugugugugucguugcaggccuuauucaagcuuaccaugaccgccggcagacgcauggaaaugcuaugcgccggccgaguccccgcacuccuacucugccucggcuuccaccuccuacaagccguccuauccaccacagucaucccaucaugcaucccaggcgaaagcucugacaacugcaccgcccuaguccaaaccgaagacaacccccgcgucgcccaagucuccaucacaaaaugcucauccgacaugaacggcuacugccuacacggccaaugcaucuaccucgucgacaugucccaaaacuacugcagaugcgaagucggcuacaccggaguccgcugcgaacacuucuuccucacaguacaccaaccucucuccaaagaauacgucgcccucaccgucauacucauuauccucuuccucaucaccguagucggcuccacauacuacuucugccgcugguaccgcaaccgcaaauccaaagaacccaaaaaagaauacgaacgcgucaccuccggcgaccccgaacucccccaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4679 - RNA, 815 nt, Artificial Sequence
  mRNA product Design3 comprising derived and/or modified sequence from Homo sapiens__NP_000791.1__HsFGF1 (opt9)
gggagagucccgcagucggcguccagcggcucugcuuguucgugugugugucguugcaggccuuauucaagcuuaccauggccgaaggcgaaaucacaaccuucaccgcccucaccgaaaaauucaaccucccccccggcaacuacaaaaaacccaaacuccuauacugcuccaacggcggacacuuccuccguauacuccccgacggcacagucgacggcacccgagaccgcucugaccaacacauccaacuccaacucucagccgaaucagucggcgaagucuacauaaaauccaccgaaacaggccaauaucucgcaauggacaccgacggccuucucuacggcucccaaacccccaacgaagaaugccucuuccucgaacgccuagaagaaaaccacuacaacacauacaucuccaaaaaacacgcagaaaaaaacugguucguaggccucaaaaaaaacggcuccugcaaacgcggcccccgcacccacuacggccaaaaagccauccucuuccucccccuacccgucucauccgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4680 - RNA, 1214 nt, Artificial Sequence
  mRNA product Design3 comprising derived and/or modified sequence from Homo sapiens__NP_001997.5__HsFGF2 (opt9)
gggagagucccgcagucggcguccagcggcucugcuuguucgugugugugucguugcaggccuuauucaagcuuaccaugguagggguaggaggaggggauguagaagaugugacgccaaggccaggagggugucaaauaagcggaagaggggcaagaggcuguaacgggauaccgggggcagcggcgugggaggcagcgcugccgagaagacgaccacgaaggcauccgagugugaacccgcggucaagagcggcagggagcccgagaacgagagggagaagaacagaggaaaggccaaguggaaguagauuaggggauaggggaagagggagggcgcuaccgggagggagauugggagggcgagggagagggagagcgccagagaggguaggagggcgggggcgggggagggggacagcggcgccgagagcggcaccagcagcgagagggagcaggccagggccggcggggacgauggcggcgggaagcauaacaacacugccggcguuaccggaggacggagggaguggggcguucccgccagggcacuuuaaagauccaaagagguuguauugcaaaaacggaggguucuuucugaggauacauccagaugggagaguagauggaguaagggagaaaucggacccacacauaaaacugcaauugcaagcagaagagagagggguagugagcauaaaaggggugugugcaaacagauaccuagcgaugaaggaagauggaagacuguuagcgucgaaauguguaacggacgagugcuuuuucuuugaaaggcucgagagcaauaacuauaacacauacaggagcaggaaguauacaucaugguauguagcacucaagagaacgggacaauacaagcuagggagcaagacggggccggggcaaaaggcaauacuauuucuaccgaugucggcaaagagcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4681 - RNA, 932 nt, Artificial Sequence
  mRNA product Design3 comprising derived and/or modified sequence from Homo sapiens__NP_002000.1__HsFGF7 (opt9)
gggagagucccgcagucggcguccagcggcucugcuuguucgugugugugucguugcaggccuuauucaagcuuaccaugcacaaauggauccucaccuggauccuacccacccuccuguaccgcagcugcuuccacaucaucugccucgucggaaccauaucccucgccugcaacgacaugacccccgaacaaauggccacaaacguaaacugcagcucccccgaacgccacacccgcuccuacgacuacauggaaggcggagacauccgcguacgccgccuauucugcagaacccaaugguaccuacgcauagacaaaagaggcaaagucaaaggcacacaagaaaugaaaaacaacuacaacaucauggaaauccgcaccgucgcagucggaaucguagccaucaaaggagucgaaagcgaauucuaccuagccaugaacaaagaaggcaaacuauacgccaaaaaagaaugcaacgaagacugcaacuucaaagaacuaauccucgaaaaccacuacaacaccuacgccuccgccaaauggacccacaacggcggcgaaauguucguagcccucaaccaaaaaggaauacccguccgcggaaaaaaaaccaaaaaagaacaaaaaaccgcccacuuccuccccauggccaucaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4682 - RNA, 974 nt, Artificial Sequence
  mRNA product Design3 comprising derived and/or modified sequence from Homo sapiens__NP_001936.1__HsHBEGF (opt9)
gggagagucccgcagucggcguccagcggcucugcuuguucgugugugugucguugcaggccuuauucaagcuuaccaugaaacuccuccccuccgucguccucaaacucuuccuagccgcaguccucuccgcacucgucaccggcgaaucccucgaacgacuccgacgcggccuggccgcaggcaccuccaaccccgacccaccaaccgucucaacagaccaacuacuaccccucggcggaggccgcgacagaaaaguccgcgaccuucaagaagcagaccucgaccuccuccgagucacccucuccagcaaaccccaagcccucgccacacccaacaaagaagaacacggaaaacgcaagaaaaaaggcaaaggccucggcaaaaaacgcgaccccugccuacgcaaauacaaagacuucugcauccacggggaaugcaaauacgucaaagaacuacgcgcccccucaugcauaugccaccccggcuaccacggcgaacgcugccacggccucucccuccccguagaaaaccgacucuacaccuacgaccacaccaccauccucgccgucgucgccgucguccucuccuccguaugccuacucgucaucguaggccuccuaauguuccgcuaccaccgccgaggcggcuacgacgucgaaaacgaagaaaaagucaaacucggaaugaccaacucccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4683 - RNA, 2534 nt, Artificial Sequence
  mRNA product Design3 comprising derived and/or modified sequence from Homo sapiens__NP_000592.3__HsHGF (opt9)
gggagagucccgcagucggcguccagcggcucugcuuguucgugugugugucguugcaggccuuauucaagcuuaccaugugggucacgaaacuccucccagcacuacuacuacaacacguccuauuacaccuccuccuccuacccauagcaauacccuacgcggaagggcagcgaaaaagacgcaacacgauccacgaguucaagaaguccgcaaaaacaacccuaaucaaaauagaccccgcccucaaaaucaaaaccaagaaagucaauaccgcagaccaaugcgcaaaccgcugcacacgcaacaaaggccucccauuuaccugcaaagccuucguuuuugacaaagccagaaagcaaugccuuugguucccauucaacagcaugagcuccggcgucaagaaagaguucggacacgaguucgaccuguacgaaaacaaagacuacauccgaaacugcauaaucggcaaaggccgcagcuacaaaggaacagucuccauaaccaaaucaggcaucaaaugccagccuuggagcuccaugauaccccacgaacacucauuccucccgucaagcuaccgagggaaagaccuacaagaaaauuacugccgaaacccacgcggggaagaaggcggacccuggugcuucaccucaaacccagaaguccgcuacgaaguaugcgacaucccccaaugcucagaaguugaaugcaugaccugcaauggagaaagcuacagagggcucauggaccacaccgaaagcggcaaaauaugccaacgaugggaccaccaaacaccacaccgacacaaauuccuccccgaacgauacccggacaaaggguucgaugacaacuacugccguaaccccgacggccagccacgcccauggugcuacacacuagacccacacacucgcugggaauacugugcaaucaaaacaugcgccgacaauaccaugaacgacacagacgucccccuggaaacaaccgaaugcauccaaggccaaggugaaggcuaccgcggcacggucaauaccauauggaacggcauacccugccaacgaugggacagccaauacccgcacgaacacgacaugacaccagaaaacuucaaaugcaaagaccuucgggaaaacuacugccgaaaccccgacggauccgaaagccccuggugcuucacaaccgaccccaacauccgcguaggauacuguucacaaaucccaaacugugacaugagccacggacaggacugcuacagagguaacggcaaaaacuacaugggcaaccucucccaaacacgauccggacugaccugcagcaugugggacaagaacauggaagaucuccauagacacaucuucugggaaccagacgcaagcaaauuaaacgaaaacuacugccgaaaccccgacgacgacgcccacggccccuggugcuacacaggaaacccucugauucccugggauuauugucccaucucccgcugcgagggcgacaccacccccacaaucgugaaccuagaccaccccguaauaucaugcgcaaaaacgaaacagcuccgaguugugaacggcauaccaacuagaacuaacaucggcuggauggucucacuacgauaccguaacaaacacaucugcggagguucgcuaauaaaagaaagcuggguccucaccgcacgccaaugcuuccccagccgggaucugaaagacuacgaagccuggcugggaauacacgacguccacgguagaggagacgaaaaaugcaaacagguccucaacguaucccaacucguauacggcccggagggcagugaccucguacucaugaaacuagcccgacccgccguccuugacgacuucguauccaccauagaccuccccaacuacggcugcaccaucccagaaaagaccagcugcagcgucuacggauggggauacaccggccuaauaaauuacgacgggcuacuccgcgucgcccaccuguacaucaugggcaacgaaaaaugcucccagcaccacagaggcaaaguaacccuaaaugaaagcgaaauaugcgcaggggccgagaaaaucggcaguggcccaugcgaaggcgacuacgggggcccccuaguaugcgaacaacauaaaaugcgcaugguccucggagugaucguccccggacgaggcugcgcgaucccaaaucgcccaggcaucuucguccgcguggcuuacuacgccaaauggauacacaaaauaauacuaaccuacaaaguaccccaaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4684 - RNA, 2273 nt, Artificial Sequence
  mRNA product Design3 comprising derived and/or modified sequence from Homo sapiens__NP_005336.3 __HsHSPA1A (opt9)
gggagagucccgcagucggcguccagcggcucugcuuguucgugugugugucguugcaggccuuauucaagcuuaccauggcuaaagcggcggcaaucggaauagaccucggaaccaccuacucaugcgugggcguuuuucagcacggcaaaguagaaauaauagcaaacgaucaaggaaacaggacaacucccucguacguggcauuuacagacacagagagacugauuggggacgccgccaaaaaccaagucgcacugaacccccagaacacaguuuucgacgcgaaaaggcucauaggacgaaaauucggagacccagugguccaaagugacaugaagcacuggccauuccaagugauaaaugacggcgacaaacccaagguacaagucucguacaaaggcgaaaccaaggcauucuacccagaagagauaucguccaugguccucacaaagaugaaagaaauagccgaagccuaccucggguacccagucacaaacgcggucauaaccguacccgcguacuucaacgacagccaacgacaagcgacaaaagacgccggagucauagcaggccucaacguacugcgcauaaucaacgaaccgaccgcggcagccauagccuacgggcuagaccgcacaggaaaaggggagcgcaacgucuuaaucuucgaccuaggcggaggcacauucgacgucucaauacuaaccauagacgacggcaucuucgaaguaaaagccacagccggggacacgcaccuaggcggcgaagacuucgauaaccgccuaguaaaccacuucguagaagaguucaagagaaagcacaagaaagacauaagccaaaacaaacgggccgugcgcaggcuaaggaccgcaugcgaacgcgcaaaacgaacccucagcucaaguacccaagcaagccuggaaaucgacagucucuucgaaggaauagacuucuacaccuccaucacccgagcgcgauucgaagaacuaugcagcgaccuauuccgcucgacacuggaaccgguggaaaaagcacucagagacgcgaagcuagacaaagcccaaauccacgaccuaguauuggugggaggcaguacaagaaucccaaaaguacaaaagcuccuacaagauuucuucaacggaagggaccucaacaaauccaucaaccccgacgaagcaguggccuacggggcagcaguccaggcagccauacugaugggagacaaaagcgaaaacgugcaagaccuacuccuccuggacguagccccacuaagccuaggacucgaaacagccggaggaguaaugacagcacugauaaaaaggaacagcaccauccccacgaaacaaacccaaaucuucacaacguacucagacaaccaacccggagugcuaauacaaguauacgaaggcgagcgcgcaaugacuaaagacaacaaccuccugggcagguucgagcuaucaggaauaccaccggcaccacggggagucccgcaaauagaagugaccuucgacauagacgccaauggcauacuaaacguaaccgcaaccgacaaaucuaccgggaaagcaaacaagauaacgaucacgaacgauaaagggcgcuuaagcaaggaagaaaucgaacgcaugguccaagaagcagaaaaauacaaagccgaggacgaaguacaacgcgaaagagugagcgcgaaaaacgcacuagaaucauacgcguucaacaugaaaagcgcagucgaagacgaaggccucaaagggaaaauauccgaggccgauaaaaagaaaguacuagacaaaugccaagaagucauaagcuggcuagacgccaacaccuuagccgaaaaagacgaguucgaacacaaaaggaaagaacuggaacaaguaugcaaccccauuauauccggccuauaccaaggagcuggaggaccgggacccggcggauucggagcccaaggccccaaaggaggaagugggagcgggcccacgauagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4685 - RNA, 2273 nt, Artificial Sequence
  mRNA product Design3 comprising derived and/or modified sequence from Homo sapiens__NP_005337.2 __HsHSPA1B (opt9)
gggagagucccgcagucggcguccagcggcucugcuuguucgugugugugucguugcaggccuuauucaagcuuaccauggcgaaagccgcagccaucggaauagaccucggcaccaccuacucaugcgucggcguauuccaacacgggaaaguagagaucaucgcaaacgaccaaggaaacaggaccacaccaucauacguagccuucacagacaccgagcgccuaaucggagacgccgccaagaaccaaguugcgcucaacccacaaaacacagucuucgacgcaaaacgacugauaggccgaaaauucggcgacccagugguccaauccgacaugaagcacuggccauuccaaguaaucaaugacggagacaaacccaaaguacaggucagcuacaaaggagaaacaaaggccuucuacccagaagaaauaagcucaaugguccugaccaaaaugaaagaaauagcagaggcuuaccucggcuaccccguaacaaacgcggucaucaccguacccgcauacuucaacgacagccaacggcaagccacgaaagacgccggagucauagcaggccuaaacguacuccgcauuauaaacgaaccaaccgccgccgccaucgcauacggacucgaccgaacaggcaagggcgagagaaacguacugaucuucgaccucggaggaggaacauucgacgucaguauacucacgaucgacgacggaauauucgagguaaaggcaacggcuggagacacacaccuaggcggagaagacuucgacaacaggcuugucaaccacuucgucgaagaguucaaacgaaaacacaagaaagacauaagccaaaacaaaagggccguccguagacuaagaaccgccugcgaaagagcgaaaaggacacucagcuccucaacccaagcaagccuagaaauagacucacuauucgaaggcaucgacuucuacaccucgaucacccgugcacguuucgaagaacuaugcagcgaccucuuccgcucaacccuagaacccguagaaaaagcacuacgagacgcgaaacuagacaaagcgcaaauacacgaccugguccuaguaggaggcucaacaagaauaccuaaaguacaaaaacucuugcaagauuucuucaauggccgcgaccucaacaaaagcauaaacccagacgaagccgucgcauauggagccgcggugcaggcagcaauccuaaugggagacaaaagcgaaaacgugcaagaccugcugcuccuagacguagcaccacucucacuuggccucgaaaccgcaggaggcguaaugacugcacuuaucaaaaggaacucgaccauacccaccaaacagacacaaaucuucacuacauacucggacaaccagcccggaguccuuauccaaguauacgagggcgaacgcgcgaugacaaaagacaacaaccuacucggaagauucgaacucucaggaauaccaccagccccacgcggcgucccacaaaucgaaguaacauucgacaucgacgcgaacggaauauuaaacgucacagccacagacaaaucgaccggaaaagcaaacaaaauaacaaucacaaacgacaaaggccgacuuaguaaagaagaaaucgagcgaauggugcaagaagcggagaaauacaaagcagaagacgaaguacaaagagagcgaguauccgccaagaacgcccucgaaucauacgccuucaacaugaaaagcgcggucgaagacgaaggccuaaaggggaagauaagcgaagcagacaagaagaaaguacuagacaaaugccaagagguaaucagcuggcuagacgcaaacacccucgcugaaaaagacgaguucgaacacaaacgaaaagaacucgagcaagucugcaaccccauaaucucgggccucuaucagggagcgggaggacccggcccagggggcuucggagcgcaaggacccaaaggcggcagcggaagcggccccacaaucgaagaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4686 - RNA, 2273 nt, Artificial Sequence
  mRNA product Design3 comprising derived and/or modified sequence from Homo sapiens__NP_005518.3 __HsHSPA1L (opt9)
gggagagucccgcagucggcguccagcggcucugcuuguucgugugugugucguugcaggccuuauucaagcuuaccauggccacagccaaggggaucgcaaucggcaucgaccuaggaaccacauauuccugcguaggagucuuccagcacggcaaaguggaaauaaucgcaaacgaucaaggcaacagaacaaccccaagcuacguagcauucaccgacacagagagacugaucggcgacgccgcgaaaaaccaaguggcaaugaacccacagaacaccgucuucgacgccaaacggcucauaggcagaaaauucaacgaccccguaguacaagccgacaugaaacucuggcccuuucaagucauaaacgaaggcggaaagcccaaaguccuaguaagcuacaaaggcgaaaacaaggccuucuaccccgaagaaaucucgagcaugguccucaccaagcugaaggaaacagcagaagccuuccuaggccacccaguaacaaacgccguaauaacagugccagcauacuucaacgacagccaacgacaagcgaccaaggaugcggguguaauagcgggccucaacguccuacgaaucauaaacgaaccuacagcggccgccaucgccuacggacuggacaaaggaggccagggagaaagacacguacugauauucgaccuaggaggcggcaccuucgacgucucaauacugaccaucgacgauggcaucuucgaaguaaaagccacugcaggcgacacccaccucggcggcgaagacuucgacaaccggcucgucagccauuucgucgaagaauuuaaaaggaaacacaagaaagacaucucccagaacaaaagagcagucagacgacuucggaccgcgugcgaacgcgcaaaacgcacgcuaagcagcaguacacaagcaaaccuagaaaucgacucccuuuacgaaggaaucgacuucuacacaucaaucacccgcgcaagguucgaggagcucugcgccgaccucuuccguggcacccuagaacccgucgaaaaagcacuccgcgacgccaaaauggacaaggcaaaaauacacgacaucguacucgucgggggcucaaccagaauccccaagguccagcgccuacuacaagauuacuucaacggacgagaccucaacaaaagcauaaauccagacgaagcggucgcguacggcgcagcaguacaggccgcgauccuaaugggggacaaaagcgaaaaaguccaagaccuccuccugcuagacguagcaccgcuuucccuaggccuagaaacagccggagguguaaugaccgcccuaaucaaacgcaacagcacaauacccaccaaacaaacccaaaucuucaccacauacagcgacaaccagccgggcguccucauacagguuuacgaaggcgaacgcgcaaugacaaaagacaacaacuuacuaggacgauucgaccugaccggcaucccaccagcacccagaggcgucccccaaauagaaguaaccuuugacauagacgccaacggcauacuaaacguaacagccacagacaaaaguacgggcaaagucaacaaaaucaccauaaccaacgacaaaggcaggcucucaaaagaagaaaucgaacggaugguccuagacgcagaaaaauacaaagcagaagacgaaguacagcgagagaaaauagcggccaaaaacgcacucgaaagcuacgccuucaacaugaaaagcguuguauccgacgaaggauuaaaaggaaaaauaagcgaaagcgacaaaaacaaaauacucgacaaaugcaacgaacuccuguccuggcuggaaguaaaccaacucgccgaaaaagacgaguucgaccacaaacgaaaagaacucgaacaaaugugcaaccccauaaucaccaaacuguaccaaggcgguugcaccggaccagccugcggaaccggcuauguacccggacgcccagcgacaggcccaaccaucgaagaggucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4687 - RNA, 2267 nt, Artificial Sequence
  mRNA product Design3 comprising derived and/or modified sequence from Homo sapiens__NP_068814.2 __HsHSPA2 (opt9)
gggagagucccgcagucggcguccagcggcucugcuuguucgugugugugucguugcaggccuuauucaagcuuaccaugagcgcacgcggccccgcaaucgggaucgaucuaggcaccacauacucgugcguaggcguauuccaacacgggaaagucgaaaucaucgcaaacgaccaaggaaaccgcaccacccccagcuacguagccuucaccgacaccgaacgacucaucggagacgcagccaaaaaccagguagcaaugaacccaaccaacacaaucuucgacgcaaaaaggcugauaggccgaaaauuugaggacgccacgguccaaagugacaugaaacauuggcccuuccgcguaguauccgaaggaggcaaacccaaaguccaaguagaauacaagggcgagaccaagaccuucuucccggaagaaauauccagcaugguccugaccaaaaugaaagaaauagccgaagccuaccuugggggaaaaguccacagcgccgucauaaccguuccagccuacuucaacgacagccaacggcaagccacgaaagacgcaggcacaauaacaggacucaacguccuucgaauaauaaacgaaccaaccgcagccgcgaucgcauacgggcucgacaaaaaggggugugcagggggcgagaaaaacguguuaauauuugaccuaggcgggggcaccuucgacguaagcauccucaccauagaagacggcauauuugaagucaaaagcaccgccggagacacacaccugggaggagaagacuucgacaaucggaugguaagccaccucgcagaagaguucaagcgcaagcacaagaaagacauugggccaaacaaaagggccgugcgacgccucagaaccgcaugcgaacgcgcaaaacgcacccugagcucaaguacgcaagcaagcaucgaaauugacagucuguacgaaggaguagacuucuacacaucaauaacacgagcacgcuucgaagaacucaacgccgaccucuuccgcggaacacuagaacccgucgaaaaagcacuccgggacgcaaaacuggacaaaggccaaauccaagaaauaguacucgucgggggauccacccgaauaccaaagauacagaaacuacugcaagacuucuucaacgggaaagaacuaaacaagucgauaaaccccgacgaagcaguagcguacggcgccgccguacaagccgcgauccugauaggagauaaaagugaaaacgugcaagaccuacugcuccuggacgucacgccccuaucacucgggaucgaaaccgcuggcggaguaaugacaccccucauaaaaaggaacaccaccauaccaaccaaacaaacccaaacauucaccaccuacucggacaaccaaucaucugugcuaguacaaguauacgaaggcgaacgggcuaugacgaaagacaacaaucuacuagguaaguucgaccuaacaggcauacccccggcaccccgaggaguaccacaaauagaaguaaccuucgacaucgaugcaaacgggauacuaaacguaaccgcagccgacaaaucgaccggaaaagaaaacaaaaucacaaucacaaacgacaaaggacgccucagcaaagacgacauagaccgaaugguucaggaagcagagagguacaagagcgaagacgaagcgaaccgagaccgaguggcggccaaaaacgcacuggaaagcuacaccuacaauauaaaacaaacaguugaagacgaaaaacuccguggaaagaucagcgaacaagacaaaaacaaaauacuagacaaaugccaagaagucauaaacuggcuggaccgaaaccagauggccgaaaaagaugaauacgaacacaaacaaaaagagcuagagcgcguaugcaaccccauaaucucgaaacuguaccaaggcggaccaggaggaggaagcggaggaggaggaucgggcgcaagcggcggcccgacaaucgaagaggucgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4688 - RNA, 2870 nt, Artificial Sequence
  mRNA product Design3 comprising derived and/or modified sequence from Homo sapiens__NP_002145.3 __HsHSPA4 (opt9)
gggagagucccgcagucggcguccagcggcucugcuuguucgugugugugucguugcaggccuuauucaagcuuaccaugagcguaguaggcaucgaccuaggguuucagagcugcuacgucgcagucgcaagagcggguggcauagaaacaauagcaaacgaauacagcgacagaugcacccccgcaugcaucucguuuggccccaaaaauagaagcauuggagcugcagccaaaagccaagucaucagcaacgcgaaaaacacgguacaaggcuucaagcgguuucacggaagggcauucagcgaccccuucguugaagcggagaaguccaaccuagcguacgacaucguccaacuacccaccggacugaccgguauaaaaguaacauacauggaagaagaaaggaacuuuacaacagaacaaguaaccgccaugcuccucagcaaacuaaaagaaacagcagaauccguccucaagaaacccgucgucgacugcgucgugucgguccccugcuucuacaccgaugcagaaaggcgcucagucauggacgcgacgcagauagcggggcucaacugccuacgccuaaugaacgagacgacagcagucgcccucgccuacggcaucuacaaacaagaccuucccgcacuagaagaaaaaccccgaaaugucgucuucgucgacaugggacacucagcauaccaaguaucuguaugcgcguucaaccgaggcaaacuuaaagugcuggccaccgccuucgacacaacacucggcggccggaaauucgacgaaguccuaguaaaucacuucugcgaagaguucggcaagaaauauaaacuagauauaaaauccaaaauacgcgcccuccugcgcuugagccaggaaugcgaaaaacucaaaaagcuaaugagcgcaaacgcgucagaccugccacugagcauagaaugcuucaugaacgacguagacguauccggaaccaugaaccggggaaaauucuuagaaaugugcaacgaccuccuagcacgcguugaacccccucuaagaucugugcuggaacaaacaaaacugaagaaagaagacaucuacgcaguagaaaucgucggaggggcaacucgaauaccggccgucaaagagaaaaucagcaaauucuucgggaaggaacucagcaccacccugaacgcagacgaagcgguaaccaggggcugcgcgcuccaaugcgccauacugucaccagccuucaaaguacgagaguucagcauaacagacguggucccauacccaauaagccuccgauggaacucaccagcagaagaaggcucgagcgacugcgaaguauucagcaaaaaccacgcagcaccauucuccaaaguccucacguuuuaccggaaagaaccguucacccucgaggcauacuacuccucaccccaagaccuccccuaccccgacccagccaucgcacaauucagcguccaaaaggucacuccccagagcgacggcaguagcagcaaagucaaagucaaaguccgcgucaacguacacgggaucuucagcguaucaucagccagccucguggaaguccacaagagcgaggaaaacgaggaaccaauggagaccgaccaaaacgccaaagaagaagagaaaaugcaagucgaccaggaagaaccccacguagaagaacagcagcagcaaacccccgcggaaaacaaagcagaauccgaagaaauggaaaccucgcaagccggcaguaaagacaagaaaauggaccaaccaccccaagcaaagaaagcaaaaguaaaaacguccacaguagaccugccaauagagaaccaacuacuuuggcaaauagaccgagaaaugcuaaacuuauacaucgagaacgaagggaaaaugaucaugcaagauaaacuagaaaaagaaagaaacgaugccaaaaacgcagucgaagaguacguuuacgagaugcgggacaaacuaagcggcgaguacgagaaguucgucuccgaggacgaccgcaacagcuucacacugaaacucgaagacaccgaaaacuggcuauacgaagacggcgaagaccaaccaaagcaaguauacgucgacaagcucgcggaacucaaaaaccucggccaaccaauaaaaauccgguuccaagaaagcgaggagagaccaaagcuauucgaagaacucggaaaacaaauccagcaauacaugaaaauuauaucaaguuucaaaaacaaagaagaucaauacgaucaucuggacgccgcagacaugacaaaaguagaaaaaucgaccaacgaagcaauggaauggaugaacaacaaauuaaaucugcaaaacaaacaaagccuaaccauggaccccguaguaaaaucaaaagagaucgaagccaaaaucaaagaacucaccuccacaugcagccccaucauaagcaaacccaagcccaaagucgaaccacccaaagaggaacagaaaaacgcagaacaaaacggccccgucgauggacagggcgauaaccccggaccgcaagccgccgaacaaggcacggacacagccgugcccucagacagcgacaagaaacuaccagaaauggacaucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4689 - RNA, 2867 nt, Artificial Sequence
  mRNA product Design3 comprising derived and/or modified sequence from Homo sapiens__NP_055093.2 __HsHSPA4L (opt9)
gggagagucccgcagucggcguccagcggcucugcuuguucgugugugugucguugcaggccuuauucaagcuuaccaugucagucgucggaauagaccucggauuccucaacugcuacauagccguagcacgcuccggagguauagagacaaucgccaaugaguacuccgacagguguacccccgcgugcaucagccugggcucccgcacucgcgccaucggcaacgcggcgaagucccaaaucgucaccaacgucagaaacacaauccacggauucaagaaacuccacggacgauccuucgacgaccccauaguccaaaccgagcgcauacgccugcccuacgaacuacagaaaaugccaaauggcagcgccggcguaaaaguccgcuaccucgaggaggaacgccccuucgccaucgaacaagucacaggcaugcuauuagcaaagcucaaagagaccuccgaaaaugcacucaagaaacccguggcagacugcguaaucagcauuccguccuucuucacagacgcagagcgacggucagucauggcagccgcacaagucgccggccugaacugucuccgacugaugaaugagacaacggccgucgcccucgcauacggcaucuacaaacaagacuuaccuccgcucgacgaaaaaccgagaaacgucgucuucaucgacaugggacacagcgcauaccaaguccucguaugugcauucaacaaaggaaaacuaaaaguucuugccaccacauucgauccauaccucggaggccgcaacuucgacgaagcacucguugacuacuucugugacgaguucaaaacaaaauacaaaauaaacgucaaagaaaacagccgcgcccuucuccgucuauaccaggagugcgaaaaacucaagaaacucaugagcgccaacgccagcgaucucccacuaaacaucgaauguuucaugaacgaccuggacgugaguuccaaaaugaaccgugcccaauucgagcaacucugcgccagcuuacuagcaagaguagaaccaccacucaaagcggucauggagcaagccaaucuccaacgggaagacaucagcuccauagagaucgucgggggagcaacccgaauacccgcuguaaaagaacaaauaacuaaauucuuccuaaaagacauaagcacaacccugaacgccgacgaagcagucgcccgaggcugcgcacuccagugcgccauacucucccccgcguucaaaguacgcgaguucaguaucacagaccucguaccauacucaaucacccuacgcuggaagacaucuuucgaagacggcuccggagaaugcgaagucuucugcaaaaaucaccccgcccccuuuuccaaagucaucacauuccacaaaaaggaaccguucgaacucgaagcguuuuacacgaaccuccacgagguaccauaccccgacgcgagaauaggaucauucaccauacaaaacguauucccacaauccgacggcgauucauccaaggucaaagucaaaguaagagucaacauacacggcaucuuuucagucgccagcgccagcgugauugagaaacaaaaccuugaaggcgaucacagcgacgcccccauggaaaccgaaacgagcuucaagaacgaaaacaaggacaacauggacaagaugcagguagaccaagaggaaggacaccaaaaaugccaugcagaacacacacccgaggaagaaaucgaccacaccggagccaaaacgaagucugccgucagcgauaagcaggaccgucucaaccaaacccucaagaaaggcaaaguaaaaagcauagaccuaccaauccaaagcucacucugccgccaacucgggcaagaccuccuaaacuccuacauagaaaacgaaggcaaaaugaucaugcaagauaaacuagaaaaagaacgcaacgacgccaaaaacgcagucgaagaauacgucuaugacuuccgagaccggcucggaaccgucuacgaaaaauucauaacccccgaggaccuaucaaaacuaagcgcuguccuagaagacaccgagaacuggcuauacgaagacggagaggaccaaccaaaacaaguauacguagacaagcuccaggagcucaagaaauacggccaacccauccagaugaaauacauggagcaugaagaaagacccaaagcacucaacgaccucggcaagaaaauccagcucguuaugaaaguaauagaagccuaccgaaacaaagacgagcgcuacgaccaccuagacccaaccgaaauggaaaaagucgaaaaaugcaucagcgaugccaugagcuggcucaacuccaagaugaacgcgcagaacaaacuaucccucacccaagaccccguaguaaaaguaucagaaauagucgcaaaaucgaaagaacuggacaacuucugcaacccaaucaucuacaagccgaaaccuaaagcagaggugccagaagacaaaccaaaagcaaauagcgaacacaacggaccaauggacgggcaauccggaacagaaaccaaaagcgauagcacaaaagacucaucccagcacacaaaaagcucaggggaaauggaggucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4690 - RNA, 2312 nt, Artificial Sequence
  mRNA product Design3 comprising derived and/or modified sequence from Homo sapiens__NP_005338.1__HsHSPA5 (opt9)
gggagagucccgcagucggcguccagcggcucugcuuguucgugugugugucguugcaggccuuauucaagcuuaccaugaaacuaagccuaguagcggcaaugcuccugcucuuaagcgccgcaagagcagaagaagaggacaagaaagaggacgucggcaccgucgucggcauagaccuaggcaccacguacagcugcgucgggguauucaaaaacggaagagucgaaaucaucgccaacgaccaaggcaacagaaucacacccagcuacguagccuucacccccgaaggagaacgccucauaggagacgcggccaaaaaccaacucaccagcaacccagagaacacaguauucgacgcaaaacggcuaaucggccggaccuggaacgaccccagcguccaacaagacauaaaauuccuccccuucaaggucgucgagaagaaaacaaaaccauacauucaagucgacauaggaggaggucaaacgaaaacauucgcacccgaggagauaagcgcaaugguacucaccaaaaugaaagaaaccgcagaagcauaccuuggaaagaaagucacgcaugccgucgucacagucccagccuacuucaacgacgcacaaagacaggcgaccaaagacgccggcacaaucgcaggacugaacguaaugcgcauaaucaacgagcccaccgccgcagccaucgcuuacgggcuagacaaacgagaaggagagaaaaacauccucguguucgaccuaggaggaggcacauucgacgucagccuccuaacaaucgacaacggaguguucgaagucguagccaccaacggcgacacgcaccucggaggagaggauuucgaccaaagaguaauggaacacuuuaucaaacuauacaaaaagaaaacaggcaaagacguacgaaaagacaacagagccgugcaaaaacuucgacgugagguagaaaaagccaaacgagcacugucgagccaacaccaagcaagaauagaaaucgagagcuucuacgaaggcgaagacuucagcgaaacccucacucgagcaaaauuugaagaacuaaacauggaccucuucagaagcacaaugaagccaguacagaaggugcucgaagacucagaccucaagaaaagcgauauagacgaaaucguccucgucgggggcagcacccggauaccgaaaauccaacaacucgucaaagaguucuucaacggaaaagaaccuagccguggaaucaacccagacgaagccgucgcguacggagccgcgguccaggcaggcguccuaucaggcgaucaagacacaggcgaccucguccuacuagacgugugcccacuaacacucggaaucgaaaccgugggcggagucaugaccaaacuaauaccccgcaacacagucguucccacgaagaaaagccaaauauucagcacggccucagacaaccagcccaccguaacaaucaaagucuacgaaggggaacgcccacucaccaaagacaaccaccuccugggcacguucgaucugacaggcauaccacccgcgccccgcggagucccgcaaaucgaaguaacauucgaaauagacgugaacgggauacugcgcgucacagccgaagacaaaggaaccggaaacaaaaacaaaaucacaauaacaaacgaccaaaaccgccuaacaccagaagaaauagaaagaaugguaaacgacgccgaaaaauucgcagaagaggacaagaaacuaaaagaacgcauagacacccgaaacgaacucgaaucauaugcauacucccucaaaaaccagaucggcgacaaagaaaaacuagggggcaaacugagcuccgaggacaaggaaacaauggaaaaagcaguagaggagaaaaucgaauggcuggaaagccaucaagacgcagacauagaggacuucaaagccaagaagaaagaacuugaagagaucguacaaccaauaaucucaaaacucuacggcucggcaggaccaccaccgacaggagaagaagacacggccgaaaaagacgaacuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4691 - RNA, 2279 nt, Artificial Sequence
  mRNA product Design3 comprising derived and/or modified sequence from Homo sapiens__NP_002146.2__HsHSPA6 (opt9)
gggagagucccgcagucggcguccagcggcucugcuuguucgugugugugucguugcaggccuuauucaagcuuaccaugcaagccccaagagaacuagccguggggaucgaccucgggacaacauacuccugcguaggcguguuccaacaaggaagagucgaaauauuagcaaacgaccaaggcaacaggaccacaccaucguacguagcguucacagacacagaacgccuagugggagacgcagcaaagucgcaagcagcacuaaauccacacaacacggucuucgacgcaaagaggcuaauaggaaggaaguucgccgacacaaccguucaaagcgauaugaagcacuggccauucagagucgucucggaaggagggaaaccaaaagugcgggucugcuacagaggcgaagacaaaacauucuacccagaagagaucuccagcaugguacugagcaaaaugaaggaaacagccgaagccuaccucggccaaccagucaagcacgcggucauaaccguacccgccuacuucaaugacagccagcgccaagccacaaaagacgccggggcaauagccggacuaaacguacuacgaaucaucaacgaacccacggcagcagcgauugcauacggccuagaccgaaggggcgccggagaacgcaauguccugauauucgaccugggagggggcacauuugacgucuccguacuaucaauagacgcaggaguauucgaagugaaagcgacggcaggagacacgcaccuaggcggcgaagacuucgacaaccgucuagugaaccacuucauggaagaguucaggcgaaaacacggaaaagaucucagcggaaacaaacgcgcacuccgcaggcuaagaaccgcaugcgaacgcgcaaaaaggacccuaagcuccucgacacaggccacccucgaaauagacucccuauucgaaggagucgacuucuacacaagcaucacccgcgcgcgauucgaagaacuaugcagcgaccuuuuccgcucaacccuagaaccagucgaaaaagcucuccgcgacgcaaaauuagacaaagcacaaauccacgaugucguccuaguaggcggcucaacgcgcauaccaaaaguacaaaagcuccugcaagacuucuucaacgggaaagaacuaaacaaauccauaaaccccgacgaagcggucgccuacggcgcggcgguacaagcagcgguccugaugggcgacaagugcgaaaaagugcaagaccuacuacuccucgacgucgccccauuaagccucggacuggagacggcaggaggaguaaugacaacacuaauccagcgaaacgcgaccauacccacaaagcaaacccaaaccuuuaccacguacucagacaaccaaccgggagucuucauccaaguauaugagggcgaacgcgcaaugacaaaagacaacaaccucuugggccgcuucgaacucuccggcaucccacccgcgccccgaggcguaccgcaaauagaagugaccuucgacauagacgccaacgggauacuaagcguaaccgcgacagaccggucaaccggcaaagcgaacaaaaucacaaucaccaacgacaaaggacggcuaagcaaagaagaaguagaacgcaugguccacgaagccgaacaauacaaagccgaagacgaagcccaacgugaccgcgucgcagcgaaaaacucacucgaagcccacguguuccacguuaaaggaucccuccaagaagaaagccugcgcgacaagauacccgaagaagaccggagaaaaaugcaggacaaaugccgugaaguacucgccuggcucgaacacaaccaacuagccgaaaaagaagaauacgagcaucaaaaacgagaacuggaacaaauuugcagacccauauuuucgagacuguacgggggcccaggcgucccaggaggcucaagcugcggaacccaagccagacaaggagaccccagcacaggaccaaucauagaggaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4692 - RNA, 1451 nt, Artificial Sequence
  mRNA product Design3 comprising derived and/or modified sequence from Homo sapiens__P48741__HsHSPA7 (opt9)
gggagagucccgcagucggcguccagcggcucugcuuguucgugugugugucguugcaggccuuauucaagcuuaccaugcaagcaccccgcgaacucgcaguaggcaucgaccuaggcaccaccuacuccugcguaggcgucuuccaacaaggccgcguagaaauacucgccaacgaccaaggcaaccgcaccacccccuccuacgucgcauucaccgacaccgaacgccucguaggcgacgccgcuaaaucccaagccgcccuaaacccccauaacaccgucuucgacgccaaacgacucaucggccgaaaauucgcagacaccaccguacaauccgacaugaaacacuggccuuuccaagucguaucagaaggaggaaaaccaaaaguccgcgucugcuaccgcggagaagacaaaacuuucuaccccgaagaaauauccagcaugguccuaucaaaaaugaaagaaaccgccgaagcauaccucggccaacccgucaaacacgccgucaucaccgucccaaccuacuucuccaacucccaaagacaagccaccaaagaugcaggcgccauagccggccuaaaaguacuccccaucaucaacgaggccaccgccgcagccaucgccuauggacuagaucgccgcggcgccggcaaacgaaacguccugauauucgaccucggcggcggcaccuucgacgucucaguacucagcauagacgcaggcgucuucgaaguaaaagcaaccgcaggagauacacaucucggcggcgaagacuucgacaaucgacuugucaaccacuucauggaagaguucagacgcaaacacggcaaagaccuaucaggcaacaaacgcgcccuacgccgccuacgaaccgccugcgaaagagccaaacgaacacccagcuccucuacgcaagcaacacucgaaauagacucccucuucgaaggcgucgacuucuacaaauccaucacccgagcacgauucgaagaauuaugcuccgaccuguuccgcagcacccucgaacccguagaaaaagcccucagagacgcaaagcuggacaaagcccaaauccacgacuucguccucggaggcggccuccacucccacccccaaggcgcagaaguagcugcaggccuccuacaacgacagggagccgaacaagaacaccaacccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4693 - RNA, 2288 nt, Artificial Sequence
  mRNA product Design3 comprising derived and/or modified sequence from Homo sapiens__NP_006588.1 __HsHSPA8 (opt9)
gggagagucccgcagucggcguccagcggcucugcuuguucgugugugugucguugcaggccuuauucaagcuuaccaugucaaaaggaccggccgucggaaucgaccucggcaccaccuacagcugcgucggcguguuccaacacggaaaaguggaaaucaucgcaaacgaucaaggcaacaggaccacacccucguacguggcauuuaccgacaccgaacgccucauuggagacgcggccaaaaaccagguagcaaugaaccccaccaacaccgucuucgacgcaaaaaggcuaaucggcagacgauucgacgacgcagucguccagagcgacaugaaacacuggccauucaugguggucaaugacgcaggccgaccaaaaguccaagucgaauacaaaggcgaaaccaagagcuucuaccccgaagaaguauccagcauggugcugaccaaaaugaaagaaauagcagaggcauaccuaggaaagaccgucacgaacgcagucgugacaguacccgcauacuucaacgacucacaacgccaagccacaaaagacgccggaacaauagccggccuaaacguacuacgcauaauaaacgaaccaacagcagcagcaaucgccuacggacucgacaaaaaggucggggccgaacgcaacguccuaaucuucgaucuaggaggagggacauucgaugucagcauccugacaauagaagacgggauauucgaagucaaaagcacagccggcgacacccaccucggaggagaagauuucgacaaccgcauggucaaccacuuuauagccgaguucaagcgcaagcacaagaaggacaucagcgaaaacaaacgagccguacgccgacuacgcaccgccugcgaacgagcaaaacgcacccugucaagcagcacgcaagcgagcauagagaucgacagccucuacgaaggcauagacuucuacacauccauaacgcgagcacgguucgaagaacucaacgccgaccuguuccgcggcacccuagacccaguagaaaaagcccuacgagacgccaaacucgacaaaucacaaauccacgacauaguucuggucggcggcuccacaagaaucccuaaaauccaaaaacuacuccaagacuucuucaacggaaaagaacucaacaaaagcauaaaccccgacgaagcaguggcguacggagcagccguccaagccgcgauccuauccggcgacaagagcgaaaacguucaagaccuucuccucuuggacguaaccccgcuaucauuaggaauagaaaccgcgggaggaguaaugacaguacuaaucaaaaggaacacuacaauaccgaccaaacaaacacaaaccuucacgacauacucagacaaccaaccaggcgugcucauacaagucuaugaaggagaacgcgcaaugacaaaagacaacaaccuacucggcaaguucgaacucacagggaucccacccgcaccccgcggaguaccacaaauagaaguaaccuucgacaucgacgccaacggaauccucaacgucagcgccgucgacaaaucaacaggaaaagagaacaaaaucacgauaacaaacgacaaagggcgccugagcaaagaagauaucgaacgaaugguucaggaagccgagaaauacaaagcagaggacgaaaagcaacgcgacaaagucagcuccaaaaacucccuagaaucauacgcguucaacaugaaagcgacggucgaagacgaaaaacuacaaggcaaaauuaacgaugaggauaaacagaaaauacuagacaagugcaacgaaaucauaaacuggcucgacaagaaccaaacagcagaaaaagaagaguucgaacaucaacaaaaagaacucgaaaaagucugcaaucccauaauaaccaaacuguaccaaagcgcgggcgggaugcccggcgguaugccgggaggcuuccccggaggcggcgccccaccaagcggcggcgcauccucaggcccaaccaucgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4694 - RNA, 2387 nt, Artificial Sequence
  mRNA product Design3 comprising derived and/or modified sequence from Homo sapiens__NP_004125.3 __HsHSPA9 (opt9)
gggagagucccgcagucggcguccagcggcucugcuuguucgugugugugucguugcaggccuuauucaagcuuaccaugauaagcgccagccgcgcagccgcggcgaggcuaguaggcgcagcggcaaguagaggaccgacggcggcaagacaccaagacucauggaacggccugagccacgaggcguucagacuggugagccgacgcgacuacgcaagcgaggccaucaaaggagcagucgucggaaucgaccuagggacgacgaacucgugcguagcagugauggagggaaagcaggcgaagguccuggagaacgcggaaggagcgagaaccacgccaucagucguagcauucaccgcggacggagagaggcucgugggaaugccagcgaaaaggcaggcaguaacaaacccaaacaacaccuucuacgcgacaaaaaggcuaauagguagaagauacgacgauccagaagugcaaaaggacaucaaaaacguacccuucaagauaguacgagccagcaacggagacgcauggguagaggcacauggcaagcuauauagcccgagccagauaggggcguucguccucaugaagaugaaggaaacggcagagaacuaccugggacacacggcaaagaacgcggucauaacagugccagcguacuucaacgacagccaacggcaagcgacaaaggacgcagggcagauaaguggacucaacguccuacgcgucauaaacgaaccaacagcggcugcccucgcauacgggcucgacaagagcgaagacaaaguaauagcaguauacgaccugggcggaggcacauucgacauaucuauacuagaaauccagaaagggguauucgaaguaaaguccacaaacggcgacacguuccuuggaggggaagacuucgaccaagcgcuauugcgucacaucguaaaggaguucaagagagagacaggaguagaccucacaaaagacaacauggcgcugcaacgaguaagagaagcagcagaaaaagcgaagugugaacuaagcucuagcguacaaacagacauuaaccucccauaucucacaauggacaguucagggccgaaacaccuaaacaugaagcucacaagagcccaguucgagggaauagugaccgaccuaauccgcaggacaauagcgccgugccaaaaggcgaugcaggacgcagaagugagcaagagcgacaucggagaagucauauuaguagggggaaugaccaggaugccgaaagugcaacagacggugcaggaccuguucggcagagcaccgagcaaggcaguaaacccagacgaggcaguagcgaucggagcggccauacaagggggaguacuugcgggagacguaacggacguacuacuauuggacgugacgccauuaagccuaggaauagaaacacuagguggcguguucacuaaacucaucaaucgaaacaccacgauacccacaaagaaaucacaaguguucagcacagcggccgacggacagacccaggucgagauaaaaguaugccaaggagagcgagaaauggccggggacaacaaacuacucgggcaauucacacugauaggaauaccgccagcacccaggggaguaccccagauagagguaacauucgacaucgacgcgaacggaauaguccacgucagcgcaaaagacaaaggaacuggcagggagcaacaaauagugauccaaagcagcggcggacugagcaaggacgacauagagaacauggugaaaaacgcggaaaaauacgcggaggaggacaggagaaagaaagaaaggguagaagcaguaaauauggcggaagggauaauacacgauaccgagaccaagauggaagaguucaaggaucaacucccagcggacgaaugcaacaaauuaaaagaagaaauaagcaagaugagggaacuacuagcgcgcaaagauagcgaaacgggagaaaacauaagacaagccgcgagcagucuccagcaggccagccuaaaacuauucgaaauggcguacaagaaaauggcaagcgaaagagaagggagcgggagcagcggaacaggagagcaaaaagaagaucagaaagaagagaagcaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4695 - RNA, 2375 nt, Artificial Sequence
  mRNA product Design3 comprising derived and/or modified sequence from Homo sapiens__NP_079291.2__HsHSPA12A (opt9)
gggagagucccgcagucggcguccagcggcucugcuuguucgugugugugucguugcaggccuuauucaagcuuaccauggccgacaaagaggcaggcggaagcgacggaccccgagaaacagccccaacauccgccuacuccagcccagcaagaucacucggcgacaccggcaucacaccacucucaccgucucacaucgucaacgacaccgauucaaacguauccgagcaacaauccuuccuaguagucgucgccgucgacuucgggacaaccuccuccggcuacgcauauuccuucacaaaagaacccgaaugcauccacgucaugcgccgcugggaaggaggagaccccggcguauccaaccagaaaacgcccacuaccauccuacuaacccccgaacgaaaauuccacuccuucggcuacgcugcccgagacuucuaccacgaccucgacccaaacgaagccaaacaauggcucuaccuagaaaaguucaaaaugaaacuucauaccacaggcgaccucaccauggacaccgaucuaaccgccgcaaacggcaagaaagugaaagcucuugaaaucuucgccuacgcccuucaauacuucaaagaacaagcacuaaaagaacucuccgaccaagcaggcucagaguucgaaaacuccgacguucgcugggucaucacaguccccgcaauauggaaacaacccgccaagcaauucaugcgacaagcagcauaccaagccggucucgcaagcccagaaaauucagaacaauuaaucauagcacucgaacccgaagccgcguccauauacugccgcaaacuucgccuccaccaaaugauagaacucuccucaaaagccgcugucaacggguacuccgguagcgacacagucggcgccggcuucacacaagccaaggagcacauacgccgcaaccgccaaucgcgaacauuccucgucgagaacgucaucggagaaaucuggucagaacucgaagaaggcgacaaauacgugguagucgacagcggcggcggaaccguggaccuaaccguccaccagauacgccugccagaagggcaccuuaaagaauuguacaaagccacaggaggacccuacggaucauuaggagucgacuacgaguucgaaaagcugcucuacaaaaucuucggcgaagauuucauugaacaauucaaaauaaaacgccccgccgcaugggucgaucugaugauagccuucgaaucacguaaacgcgcagccgcucccgaccgaaccaauccacucaacaucacccuacccuucucauucaucgacuacuauaagaaauuccgcgggcacuccgucgaacaugcucuccgaaaaucaaacgucgauuucgucaaauggucaucccaaggcaugcuccgcaugucaccggacgccaugaacgcacuauucaaacccacuauagacucaauaaucgaacaccuacgcgaccucuuccaaaagcccgaaguaagcacagucaaauuccucuuccucgugggcggguucgccgaagccccacuccuccaacaggccguccaggccgcauucggagaccagugccguaucauaaucccacaagacguaggccuaaccauacucaaaggcgcaguccuauucggccuagaccccgccgucauuaagguccgccguucccccuuaacauacggagucggcguccuuaaccgcuaugucgaaggaaaacacccacccgaaaagcuccuagucaaggacggcacccgauggugcaccgacgucuucgacaaauucauauccgcagaccaaagcguugcacucggcgaacuugucaaacgaucauacacccccgcgaaacccucacaauuagucauagucauaaacaucuacuccucagaacacgacaacguuuccuucaucaccgaccccggcguaaagaaaugcggaacccucagacuggaccucaccggcacauccggcacugccguacccgcacgacgcgaaauacaaacccucaugcaguucggcgacaccgaaaucaaagcaacugccaucgacauagccacaucaaaauccguaaaaguaggaaucgacuuccuaaacuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4696 - RNA, 2408 nt, Artificial Sequence
  mRNA product Design3 comprising derived and/or modified sequence from Homo sapiens__NP_443202.3 __HsHSPA12B (opt9)
gggagagucccgcagucggcguccagcggcucugcuuguucgugugugugucguugcaggccuuauucaagcuuaccaugcuagcaguccccgaaaugggccuacaaggccucuacaucggcuccagccccgaacguucacccguacccucaccaccaggcucaccaagaacccaagaaaguugcggcaucgccccacucacgcccucccaaucccccaagcccgaaguccgagcaccccaacaggcuucauucucugucgucguagcaauagacuucggaaccaccucuagcggcuacgcuuucucauucgccagcgaccccgaagccauccacaugaugcgcaaaugggaaggaggagaccccgguguagcacaccagaaaaccccaaccugccuacuccucacacccgaaggagccuuccacagcuucggcuacaccgcccgagacuacuaccacgaccucgaccccgaggaggcucgugacuggcucuacuucgaaaaauucaaaaugaaaauccacuccgccaccgaccucacccucaaaacucaacuagaagcgguuaacggaaaaacaaugcccgcccuagaaguuuucgcacacgcccugcgcuucuuccgagaacacgcacuccaagaacuucgcgaacaaagcccgagccuuccugaaaaagacaccguucgaugggucuugacaguccccgcaauauggaaacaaccggcgaaacaauucaugcgagaagcagccuaccuagccggacugguaucccgagaaaacgccgagcaacuacucaucgcacucgaacccgaagcugcauccgucuacugccgcaaacuacgccuccaccaacuccucgaccuguccggccgcgcaccaggaggcgguagauugggugagcgacgcaguauagacaguuccuuucgacaagcacgcgaacagcuacgccgaagccggcacucccgaacuuuccuuguagaaucaggcgucggcgaacucugggccgaaaugcaagcaggagacagauacguaguugcggacugcggcggcggcaccguugaccugacaguccaccaauuagaacaaccacacggcacucucaaagaacuuuacaaagcauccggcggacccuauggcgccguaggagucgacuuagcauuugaacaacuccugugcagaaucuucggggaagacuuuauagcaaccuucaaaagacaaagacccgcagccugggucgaccuuaccaucgcauucgaagcacggaaacgaacagccggcccacaccgagcaggagcccugaacaucagccuaccauucucauucaucgauuucuaccggaaacaacgcggccacaacgucgaaacagcccuccggcgaagcagcgucaacuucgucaaauggucaucccaaggaaugcuacgaauguccugcgaagcaaugaacgaacucuuccaaccaaccgucucgggcaucauccaacacaucgaagccuuacuagcccgcccagaaguacaaggagucaaacuccucuuccuagucggaggcuucgcagaguccgcaguccuacaacacgcgguucaggccgccuuaggagcacgcggccuccgagucgugguaccccacgacguaggccucacaauccuaaaaggcgccguucucuucgggcaagcucccggcgucguacgcguacgccgcagcccacuaaccuacggcguuggcguacucaaccgcuucgucccgggaagacacccacccgaaaaacuccuaguccgagacgguagacgcuggugcaccgacgucuuugaaagauucguggccgccgaacaaucagucgcccucggcgaagaaguccgacgcagcuacugccccgcacgccccggccaacgacgcguccucaucaaccuauacugcugcgcagcagaagacgcacgcuuuauaaccgaccccggcguccgaaaaugcggcgcacucucacucgaauuagaacccgcagacugcggucaagacaccgccggagccccgcccggaagacgagaaauccgcgccgcaaugcaauucggcgacaccgaaaucaaagucacagccgucgaugucuccacaaaccgaagcguaagggccucgauagacuuccuaaguaacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4697 - RNA, 1763 nt, Artificial Sequence
  mRNA product Design3 comprising derived and/or modified sequence from Homo sapiens__NP_008879.3__HsHSPA13 (opt9)
gggagagucccgcagucggcguccagcggcucugcuuguucgugugugugucguugcaggccuuauucaagcuuaccauggcaagagaaaugacaauccuuggcuccgccgugcuaacccuccuacuagccgguuaccucgcccaacaguaccuaccccuccccaccccaaaagucaucggaaucgaucucggcaccaccuacugcucagucggcgucuucuuccccggcaccggaaaaguaaaaguuauaccggacgaaaacggccacaucuccauccccucaauggucuccuucaccgacaacgacgucuacgucggcuacgaaagcguggaacucgccgacuccaacccccaaaauacaauauacgacgccaaacgcuucaucggcaaaaucuucaccgccgaagaacucgaagccgaaauaggccgcuacccuuucaaagugcucaacaaaaacggcauggucgaguucuccgucaccagcaacgaaacaauaacaguaucgccagaauacgucggcucccgccuccuccuuaaacuaaaagaaauggcagaagccuaccuaggcaugcccgucgccaacgcaguaaucucagucccagccgaguucgaccuuaaacaaaggaacuccaccaucgaagcagcuaaccucgccggccugaaaauccuccgagucaucaacgaacccaccgccgcggccauggcauacggacuucacaaagccgacgucuuccacguccucguaaucgaccugggcggcggcacccuagacgucagccuucucaacaaacagggaggcauguuccucacacgcgcgaugucaggaaacaacaaacuaggaggccaggacuucaaccaacgccuacuccaauaccuauacaaacaaauauaccaaaccuacggauucguuccaucccgaaaagaagaaauccacagacuccgacaagcaguagaaaugguaaaacucaaccuaacccuacaccaauccgcacaacuaagcguccuccuuacaguagaagaacaagaccgaaaagaaccacacuccuccgacaccgaacuccccaaggauaagcuauccagcgcugacgaccacagaguaaacuccgguuucggccguggccucagcgacaagaaaucuggugaaucacagguccuauucgaaaccgagauaucccgaaaacucuucgacacccucaacgaagaccucuuccagaaaauccucguccccauccaacaaguccucaaagaaggccaccucgagaaaacagaaaucgacgaagucguacucguaggaggcuccacacgcaucccccgcauccgacaaguaauccaagaguucuucggcaaagaccccaacaccucaguagacccugaccuggccgucguaaccggagucgccauccaggccggaauugauggcggauccuggccccuacaagugagcgcccucgaaaucccaaacaaacaccuccagaaaacaaacuuuaacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4698 - RNA, 1877 nt, Artificial Sequence
  mRNA product Design3 comprising derived and/or modified sequence from Homo sapiens__NP_057383.2__HsHSPA14 (opt9)
gggagagucccgcagucggcguccagcggcucugcuuguucgugugugugucguugcaggccuuauucaagcuuaccauggccgcaauaggcguccaccuaggcugcaccagcgccugcgucgccgucuacaaagacggcagagcaggcguagucgccaacgacgccggagaccgcgucaccccagcagucgucgccuacagcgagaacgaagaaaucguggggcucgcagccaaacaaucccgcauccgaaauaucuccaacacagucaugaaaguaaaacaaauccuaggacgcaguucgucagauccccaggcccaaaaauacauagccgaaucaaaaugccuaguaauagagaaaaacggcaaacuccgauacgaaaucgacaccggugaagaaacaaaauucguaaacccagaagacgucgcacgccuaauauucagcaagaugaaagaaaccgcccacucugugcucggaagugacgccaacgacguagucaucaccguaccauucgacuucggcgaaaaacagaaaaacgcccuaggcgaagccgcaagagccgccgguuucaacguccugcgacucauacacgaaccaagcgccgcgcuccucgccuacggcaucggccaagacuccccaaccgggaaguccaacauccuaguauucaagcuaggaggcaccagucuaucccuauccgucauggaagucaacagcggcauauaccgcguacucucaaccaacacagacgacaacaucggcggagcccauuucaccgaaacacuagcccaauaccucgccuccgaguuccaacgcucuuucaaacacgacguccgcggcaacgcgcgcgccaugaugaaacuaaccaacagcgccgaaguagcuaaacacucacucucaacacucggcuccgcaaacugcuuucuugacagccuauacgaaggccaagacuucgacugcaacgucucaagagccagguucgaacuacuaugcucaccacucuucaacaaaugcaucgaagccauacguggacuacucgaccaaaacggauucacugccgacgacaucaauaaaguaguacucugcggaggaucuucacgaauaccuaaacuacaacaacucaucaaagaccucuucccagccgucgaacuucuuaacuccaucccacccgacgaagucauccccaucggcgccgccaucgaagccggcauccucaucggaaaagaaaaccuacuuguagaggacucccucaugaucgaaugcuccgccagagacauccuagucaaaggcguagacgagagcggcgccagccgauucaccguccuauuccccuccggaacaccacuaccagcccgacgccaacacacacuacaagccccaggaucaauauccuccgucugccucgaacucuacgaaagcgacggcaaaaacuccgcaaaagaagaaaccaaauucgcacaagucguccuccaagaccucgacaagaaagaaaacggccuccgcgacaucuuagcagugcucaccaugaaacgcgacggcagccugcacguaacaugcacagaccaggaaaccggcaaaugcgaagccaucuccauagaaaucgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4699 - RNA, 2924 nt, Artificial Sequence
  mRNA product Design3 comprising derived and/or modified sequence from Homo sapiens__NP_006635.2 __HsHSPH1 (opt9)
gggagagucccgcagucggcguccagcggcucugcuuguucgugugugugucguugcaggccuuauucaagcuuaccaugagcguaguaggacucgacguagggagccaauccugcuacauagccgucgcccgcgccgguggcaucgaaaccaucgcaaacgaguucagugaccgaugcacccccuccguaauauccuucggaagcaaaaacagaaccauaggcguagcugcuaaaaaucagcaaaucacacacgcgaauaacacggucucaaacuucaaacgauuccacggcagagccuucaaugaccccuucauccaaaaagaaaaagaaaaccuaucauacgaccuaguaccccucaaaaacggaggcguaggaaucaaagucauguacaugggagaagaacaccuauucagcguagaacaaauaacugccaugcuacucaccaaacucaaggaaaccgcagaaaacucacugaaaaagccagucaccgacugcgugauaagcguccccucuuucuucaccgacgccgaacgccgaucgguccuagacgcagcccaaauagucggccuaaacugucuacgacuaaugaacgacaugacagcaguggcccugaacuacggcaucuauaagcaagaccugcccucgcucgacgaaaaaccacgcaucguaguauucgucgauaugggccacucagcauuccaagugucagccugcgcauucaacaagggcaaacucaaagugcuaggcaccgccuucgaccccuuucucggaggcaaaaacuucgacgaaaagcuaguggaacacuucugcgcagaauuuaaaaccaaauauaaacucgacgccaaauccaaaaucagagcccugcuacgacucuaccaagaaugcgaaaaacuaaagaaacugauguccuccaacucaaccgaccugccccugaacaucgaaugcuucaugaacgacaaagacgucuccgggaaaaugaacagaucacaauucgaagaacuuugcgccgaacuacuccagaaaaucgaaguaccacucuacucccuccuggaacaaacccaccuaaaagucgaagacguguccgccguagaaauugucggcggcgcaacacgcauaccggccguaaaagaacgaauagcgaaauucuucggcaaagacaucuccaccacccuuaacgcagacgaagccgucgcacgcggcugcgcccuccagugcgcaauacucucgccggccuucaaaguccgcgaguucuccgucacggaugccgucccauucccgaucucccugauuuggaaccacgacagcgaagacacugaaggaguccaugagguauucagccgaaaccacgcagcucccuucagcaaaguacucacauuccuacgccgcggaccauucgaacuggaagcguucuacagugacccccagggaguaccguacccggaagcaaaaaucggacgcuucguggugcaaaacguaucagcacaaaaggacggcgagaaaagccgcgucaaaguaaaaguaagaguaaauacgcacggaaucuucacaaucucaacagccucaauggucgaaaaaguacccaccgaggaaaacgaaaugagcuccgaagccgauauggaaugccucaaccaacgcccacccgaaaaccccgauacagacaagaacguccaacaagacaauuccgaagcgggcacacaaccccagguccaaacagacgcacagcaaacaagccaguccccacccucacccgagcucaccucggaagagaacaaaauacccgaugccgacaaagcuaacgagaaaaagguggaccaaccacccgaagccaagaaacccaaaaucaaagucguuaacguagaacuaccaauagaagccaaucuuguauggcagcucgggaaagaccuccugaauauguacaucgaaacagaaggcaaaaugaucaugcaggacaaacucgaaaaagaacgaaacgaugccaaaaacgccgucgaagaauacguauacgaguuccgagacaaacuaugcggccccuacgaaaaguucaucugcgaacaagaccaucaaaacuuccuccgacuccucaccgaaacagaagacuggcuauacgaagaaggcgaagaccaagccaagcaggcguacguagacaaacuagaggaacuaaugaaaaucgggaccccuguaaaaguacgauuccaagaagccgaagaacgaccaaaaauguuugaagaacugggacagcgccuccagcacuacgccaagaucgccgcagacuuccgcaauaaagacgaaaaauacaaccauauagacgaaagcgaaaugaaaaaggucgaaaagagcgucaacgaggucauggaauggaugaacaacgucaugaacgcucaagccaagaaaagucuagaccaagaccccguagugagggcgcaagaaaucaaaaccaaaauaaaagagcugaacaacacaugugaaccagucgucacgcaaccgaaaccaaaaaucgaaagcccgaaacucgagcgcacacccaacggacccaacaucgacaagaaagaagaagaccuagaagacaaaaacaacuucggugccgagcccccgcaccaaaacggugaaugcuaucccaacgagaaaaacagcgugaacauggaccuugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4700 - RNA, 3347 nt, Artificial Sequence
  mRNA product Design3 comprising derived and/or modified sequence from Homo sapiens__NP_006380.1 __HsHYOU1 (opt9)
gggagagucccgcagucggcguccagcggcucugcuuguucgugugugugucguugcaggccuuauucaagcuuaccauggcagacaaagugagacgacaacguccgcgucggcggguuugcugggcacucguggcaguccuccuagcagacuugcucgcccuaagcgauacccuagcagugaugucuguagacuuaggaucggaaucgaugaaaguagccaucgucaaaccgggagugccaauggaaaucguacuaaacaaagaaucacgcaggaaaacccccgugaucgucacgcugaaagagaaugagcgauucuucggcgauuccgcagcauccauggcgaucaaaaacccgaaggcaacacugagauacuuucagcaccuccucggaaaacaggcagacaacccacacguagcccucuaccaagcacgcuuccccgagcacgaacuaacauucgacccccaacgccaaaccgugcacuuccaaaucagcagucagcuccaauuuagcccagaagagguacucggaaugguacucaacuacuccaggagccucgcugaagauuuugccgaacagcccauaaaagacgcagucauaacaguacccgucuucuucaaccaagccgaaagacgagcgguacuccaagcagcaagaauggccggccucaagguccuucaacugaucaacgacaacacagcgacagcacucuccuacggaguauucagaagaaaagacauaaacaccacagcacagaacaucauguucuacgacaugggaagcggaaguacuguuugcacaauaguaaccuaccaaaugguaaagaccaaagaggcaggaaugcaaccacaacuucaaauacgaggggucggcuuugacaggacucuaggaggacuggagauggaacuccggcuucgagaacgccuagcaggacucuucaacgaacaacgaaagggccagagagccaaagacguacgagaaaauccacgagcaauggccaaacuccuaagagaagcgaaccgacucaaaacgguccuaagcgcaaacgcggaccacauggcccaaaucgaaggacuaauggacgacguugacuucaaagccaaaguaacacgaguagaguuugaagaacucugcgccgaccucuucgaacgagugccaggaccgguacaacaagcacuccagagcgcagaaaugucccuagacgaaaucgagcaagugauccuaguaggaggcgcaacccggguaccacgcguacaagaaguauuacugaaagcggugggaaaagaagaguuagggaaaaacauaaacgccgacgaagccgcagcaaugggagcaguauaccaagccgcggcccucagcaaagccuucaaaguaaaacccuucguagugcgggacgcagucguauacccaauacugguggaguuuaccagagaagucgaagaggaacccggcauccacagccuaaaacacaacaaaagaguccuguucuccaggaugggacccuacccacaacgcaaggugauaacauucaaccgauacagucacgacuuuaacuuccacauaaacuauggggaccugggcuuccuaggacccgaggaccuccgcgucuucggaucccaaaaccuaacaaccguaaaacucaaaggaguaggagacucuuucaaaaaguaccccgacuacgaaucaaaggggauaaaagcccacuuuaaccucgacgaaagugggguccucagccuggaccgcguagagucggucuucgaaacacucgucgaagacagugccgaagaagaaucaacccuaacgaaacuaggcaacacaauaucaagccucuucggaggaggcacaacaccugacgccaaagaaaacggaacagacaccguacaagaagaagaggaaagccccgcggagggaucaaaagacgaaccaggcgaacagguggaacucaaagaagaagcggaagccccagucgaggauggaagccaacccccaccacccgaaccgaaaggcgacgcaacaccggaaggcgaaaaggccaccgagaaagaaaacggggacaagucagaagcccaaaagccaagugaaaaagccgaagcaggcccagaaggaguagccccggccccagaaggagagaaaaagcagaaacccgccaggaaacgccgaaugguggaggagauaggcgucgaacucguaguacuggaucuaccagaccuccccgaagauaagcuagcacaaagcgugcaaaaacuccaggaccucacccugcgcgacuuagaaaaacaagagagagagaaagcagcaaacagccuggaggccuucaucuucgaaacacaagacaagcuguaccagcccgaauaccaagaagugagcacggaagaacaaagagaagagaucuccggcaagcuauccgcagccagcacguggcucgaagacgaaggaguaggggccacaacaguuaugcucaaagaaaaauuagcagaacuaagaaagcuaugccaaggacuauuuuucagaguggaagagagaaagaaauggccggaaaggcucagugcccucgacaaccuacucaaccauuccagcauguuccugaagggcgcaaggcuaauaccagaaauggaccaaauauucacagaaguagaaaugaccacucucgagaaaguaauaaacgagacaugggcguggaaaaacgcaacccucgcagaacaagcgaagcugccagccacggagaagccgguucuacucagcaaggauauagaagcaaagaugauggcacuagacagagaaguccaguaccuguuaaacaaagcaaaauucacaaaaccacgcccaaggccgaaagacaaaaacggaacacgagcagaaccaccacugaacgcgucagcuucagaccaaggagaaaaaguaauacccccagcagggcaaaccgaggacgcagaaccaaucagugaaccagagaaaguugagacgggaagcgaaccaggagacacggaacccuuagaauuaggaggcccaggcgcagaaccagaacaaaaagagcaaagcacuggccaaaagcguccccucaaaaacgacgagcuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4701 - RNA, 2546 nt, Artificial Sequence
  mRNA product Design3 comprising derived and/or modified sequence from Homo sapiens__NP_005339.3 __HsHSP90AA1 (opt9)
gggagagucccgcagucggcguccagcggcucugcuuguucgugugugugucguugcaggccuuauucaagcuuaccaugcccgaagagacgcaaacgcaagaucaaccgauggaggaggaagaaguggaaaccuucgcguuccaggcagaaaucgcgcaacugaugagccucauaaucaacacguuuuacagcaacaaagaaauauuccugcgcgagcuaauaagcaacagcagcgacgcacucgacaagauacguuacgaaucccuaacggacccgagcaaacuagacagcgggaaggaacuacacaucaaccucauccccaacaagcaggaccgaacccugaccauagucgacaccggaauagggaugacgaaagcagaccucaucaacaaccucggaacgaucgccaaaagcggcacgaaggcuuucauggaagcacuacaagcgggcgccgacauaaguaugauaggccaauucggaguaggauucuacagugccuaccuaguggcagagaaagucaccguaauaacaaaacacaacgacgacgaacaauacgccugggaaagcagcgccgggggcuccuuuacaguaagaacagacaccggagaaccaaugggccgcggaacaaaaguaauacuccaccuaaaagaggaccaaacagaauaccucgaggaaagacgaauaaaggagaucgucaaaaagcacagccaauucauaggauacccaauaacgcuauucguggaaaaagaacgagacaaagaagugucagacgacgaagcggaggaaaaagaggauaaggaagaagagaaagagaaagaagaaaaagaaagcgaagacaagccagaaaucgaggacguagggucggacgaagaggaggaaaagaaagacggcgauaagaaaaagaaaaagaaaaucaaagaaaaguacaucgaccaagaggagcuaaacaaaacaaaaccgaucuggacacgaaacccagacgacaucacgaacgaggaauacggcgaguucuacaaaucacucacaaacgacugggaagaccaucuagcaguaaagcacuucagcgucgaaggccaacuggaguucagagcucuccuguucguacccaggcgcgcccccuucgaccucuucgaaaacagaaagaagaaaaacaacauaaaauuauacguaagacgaguauucauaauggacaacugcgaagaacugaucccggaauaccucaauuucauccgcggagucguagacagcgaggaccuaccacuaaacauaagcagagagaugcuacagcagaguaaaauccuaaaaguaauacggaaaaaccuugucaaaaagugccuggagcuauucaccgaacuugcagaggacaaagaaaacuacaagaaguucuacgagcaguucagcaagaauauaaaacuaggcauacacgaagacucacagaaccgcaagaaacuaagcgaacuccugagauacuacaccagcgccagcggggacgagauggucagccuaaaagacuacugcacaagaaugaaagaaaaccaaaaacacaucuacuauaucacgggagaaacaaaagaccaggucgcgaacucagccuucgucgagcgacuccgcaaacacgggcucgaaguaaucuauaugauagagcccauugacgaguacugcguacagcaacuaaaagaguucgaaggaaaaacccucguaagcgucacgaaagaaggccuagaacugcccgaagacgaagaggagaaaaagaaacaagaagaaaagaaaacaaaauucgaaaaccugugcaaaaucaugaaagacauccuggagaagaaaguggagaaaguagucguaagcaaccgccuaguaacgagcccaugcugcauagucacaagcacauacggauggacggcgaacauggagcgaauaaugaaagcccaagcccugcgagacaacagcacaaugggauacauggcggccaaaaagcaccuagaaaucaaccccgaccacuccaucaucgaaacacucagacaaaaagccgaagccgacaaaaacgacaaaagcguaaaggaccuggugauacuccuuuacgaaaccgcccugcucucaagcggcuucucccuggaggacccacagacccacgcgaacagaaucuacagaaugauaaagcugggccuaggaauagacgaagacgacccaacagccgacgacacauccgcagccgucaccgaagaaaugccaccccuagaaggggacgacgacacaagcagaauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4702 - RNA, 686 nt, Artificial Sequence
  mRNA product Design3 comprising derived and/or modified sequence from Homo sapiens__NG_005218__HsHSP90AA3P (opt9)
gggagagucccgcagucggcguccagcggcucugcuuguucgugugugugucguugcaggccuuauucaagcuuaccauggacucaucaaaacuagacuccggcaaaggccuacacauaaaccucguccccaacaaacaaaaccaaacccucaccaucguagacacacgcaucggcaugaccaaaaccgaccucaucaacaaccucggaaccgucaccaaauccggcacaaaagccuucauggaagcccuccaagcagacgcagacauauccaugaucggccacuucggaguaggcuucuacuccgccuaccucgucgccaaaaaagucaccgucaucucaaaacacaacaacgacgaacaauacaccugggaauccuccgcaggaggcagcuucaccguccgcaccgacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4703 - RNA, 2522 nt, Artificial Sequence
  mRNA product Design3 comprising derived and/or modified sequence from Homo sapiens__NP_031381.2__HsHSP90AB1 (opt9)
gggagagucccgcagucggcguccagcggcucugcuuguucgugugugugucguugcaggccuuauucaagcuuaccaugcccgaggaaguacaccacggagaagaggaagucgaaaccuucgccuuccaagcggaaaucgcccaacuaaugagcuugauaauaaacacguucuacuccaacaaagagauauuccugcgggagcuaauaucgaacgccagcgacgcccuagacaagaucagguacgagucccucaccgaccccagcaaacuagacucgggcaaggaacugaaaaucgacauaaucccgaacccgcaagagcgcacccucacccuaguggacacgggaauaggcaugaccaaagcagaccucauaaacaaccucggcaccauagccaagagcggaaccaaggccuucauggaagcacugcaagcaggagcagacauaaguaugaucgggcaauuuggcguaggguucuacucagcguaccucgucgccgaaaaaguaguagucauaacgaaacacaacgacgacgagcaauacgcgugggagucaagcgcaggagggagcuucaccguacgggcagaccauggcgaacccauaggcagaggcaccaaaguaauccuccaccuaaaggaagaccaaacagaguaccuagaagaacggagaguaaaagaagucgucaagaaacacucccaauucauaggcuaucccaucacacuauaccucgagaaagaacgagaaaaagaaauauccgacgacgaagccgaagaagaaaaaggggaaaaagaagaggaagacaaagacgacgaagaaaagcccaaaauagaagacguuggcucggacgaggaggacgacagcggcaaagacaagaaaaagaaaacgaagaaaauaaaagagaaauacaucgaucaagaagaacucaacaaaaccaaaccgaucuggacacggaaccccgacgauaucacgcaagaggaguacggcgaguucuacaaaucacuaacgaacgacugggaagaccaccucgcggucaagcacuucaguguggaaggccaacuagaguuccgagcgcuauuguucaucccaagacgcgcacccuucgaccucuucgaaaacaaaaagaagaaaaauaacauaaaacuguacguacgacggguguucaucauggacagcugcgacgaauugauaccggaauaccugaacuucauccgaggagucguggacucagaagaccucccacuaaacaucucccgagaaaugcuucaacagagcaaaauccuaaaagugaucaggaaaaacaucguaaagaaaugcuuagaacuauucagcgaacuagcagaggacaaagaaaacuacaagaaauucuacgaagccuucagcaaaaacuugaaacuaggcauacacgaagacagcacgaaccgaaggcgcuuguccgaacuacuacgcuaccacacgucccagagcggcgacgagaugaccagccugagugaauacgugagccgcaugaaagaaacgcagaaaagcauauacuacauaacaggcgaaagcaaagaacaaguagcgaacagugccuuugucgaaagaguacgaaaacgcggauucgaggucguauacaugacggaaccaauagaugaguacugcguccaacaacuaaaagaguucgacgggaaaagccuagucaguguuacgaaagagggccucgaacuacccgaagacgaggaggagaaaaagaaaauggaagaaagcaaagcaaaauucgaaaaccugugcaagcucaugaaagaaauauuggacaagaaagucgaaaaaguaacgaucucgaaucgacucguaucaucccccugcugcauagucacgagcacauacggauggacagcgaauauggagcggaucaugaaggcacaagcccuacgcgacaacagcaccaugggcuacaugauggcgaagaaacaccucgagauaaacccagaccacccgaucguggagacgcuaagacagaaagcagaagccgacaaaaacgacaaagccguaaaagaccuaguaguacugcuauucgaaacagcccugcucagcagcggauucucacucgaagacccgcaaacccacagcaaccgaaucuaccgcaugaucaagcucggacucggcaucgacgaagacgaaguagccgccgaagaaccgaacgcagccgucccugacgagauaccgccccucgaaggcgacgaggacgcaagccgaauggaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4704 - RNA, 2759 nt, Artificial Sequence
  mRNA product Design3 comprising derived and/or modified sequence from Homo sapiens__NP_003290.1__HsHSP90B1 (opt9)
gggagagucccgcagucggcguccagcggcucugcuuguucgugugugugucguugcaggccuuauucaagcuuaccaugcgagccuuauggguccucggacucugcugcgugcuacugaccuucggcagcguaagagcagacgacgaggucgacguagacggcacgguagaggaagaccucggcaaaucgcgagaaggcucacgcacagacgacgaaguaguccagcgagaagaagaagcgauacaacuugacgggcugaacgcgagccagauccgcgaacucagggagaaaagugaaaaauucgcauuucaggcagaaguuaacaggaugaugaagcuaaucauaaauucccuguacaaaaacaaagagaucuuccuacgggaacuaauaucaaacgccagcgacgcucuagacaaaaucagacuaauaagccuaacagacgaaaacgcacuaagcggaaacgaagaauugacagucaaaaucaagugcgacaaagagaaaaaccugcugcacgucaccgacacaggcgugggcaugacccgagaggaacucgucaaaaaccugggaacgauagcaaagucagggaccagcgaguuccucaacaaaaugacagaagcccaggaggacgggcagagcacgagcgaacugauagggcaauucggaguaggauucuacagcgcguuccugguagcggacaaagucauagucaccagcaaacacaacaacgauacccagcacaucugggagagcgacaguaacgaauuuagcguaaucgcagacccucgaggcaacacacuagggcgagggaccacaauaacacugguacuaaaggaagaagccagugacuaccucgagcuagauaccaucaagaaucucguaaagaaauacucacaauucaucaacuucccaaucuacgucuggagcagcaaaacagaaacgguugaagaaccuauggaggaagaggaagcggcaaaagaggaaaaggaagaaucagacgacgaggccgccguggaagaggaagaagaggaaaagaaaccaaaaacgaagaaaguggagaaaacaguaugggacugggaacugaugaacgacaucaagcccauauggcaaagaccaagcaaggaaguagaagaagacgaguacaaggcguucuacaaaaguuucuccaaggagucagacgaccccauggcauauauacacuucacggcagagggcgaagucacauucaagagcauacucuucgugcccaccucggcaccacgcggacuauucgaugaguacgggagcaagaaaagcgacuacauaaaacuauacgucaggaggguauucauaacggacgacuuccacgacaugaugcccaaguaccugaacuucgucaagggaguagucgauagcgaugaccuaccccugaacguaagcagggaaacccuacaacaacacaaacuucucaaaguaauccggaaaaagcucgugaggaagacccuagacaugauaaagaaaauagcggacgacaaauacaacgacacauucuggaaagaguucgggacaaacauaaaacuaggugugauagaggaccacagcaacaggacgagacuggccaaacuccuacgauuccaaucaagccaucaccccacagacaucacgagccuagaccaguacguagaaagaaugaaggaaaaacaggacaaaauuuacuucauggcaggguccagcagaaaagaggccgaaagcucccccuucgucgaaaggcugcucaagaaaggguaugaagucauauaccuaacagagccagucgaugaauacugcauacaggcacugccagaguuugacggcaagagauuccaaaacgucgcaaaagaaggagugaaauucgacgaaagugagaagaccaaagagagcagagaagccgucgagaaagaguucgaaccucuccucaacuggaugaaagacaaagcgcuaaaagacaagauagaaaaagcagucguaagccaacgacucacagaaagcccaugcgcgcuagucgccucgcaauacggauggucagggaacauggaaagaaucaugaaagcgcaagcguaccaaacugggaaagacauauccacgaacuacuacgccagccaaaagaaaacguucgaaaucaaccccaggcauccacugauaagggauaugcuacgcagaauaaaagaagacgaggacgacaaaacaguccucgaccucgcagucguccucuucgaaacggcaacccuuagaagcggcuaccugcugccagacaccaaagccuacggagacaggaucgagcgaaugcuacgacucucacuaaacauagacccggacgcaaaaguagaggaagaaccggaggaggagccagaagaaacagccgaagauacaacagaggacacggaacaagacgaagacgaagaaauggacguagguacagacgaggaagaagaaacagccaaagagagcacagcggagaaggacgagcuauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4705 - RNA, 2462 nt, Artificial Sequence
  mRNA product Design3 comprising derived and/or modified sequence from Homo sapiens__NP_057376.2__HsTRAP1 (opt9)
gggagagucccgcagucggcguccagcggcucugcuuguucgugugugugucguugcaggccuuauucaagcuuaccauggcccgagaauuaagagcccuauuacucuggggacgucgucuccguccccuccuccgcgcaccagcccuagcagccguacccggcggcaaacccauucucugcccaagaagaaccacugcccagcuagggccccgacgaaaccccgcguggucgcuccaagcuggacgacucuucucaacccaaaccgcagaagacaaagaagaaccccuccacagcaucauaucuucaacagaauccguccaagguagcacauccaaacacgaguuccaagccgaaaccaagaaacuguuagauaucgucgcccgcucccucuacagcgaaaaagaagucuucauccgcgaacugaucucaaacgccagcgacgcccuagagaaacuacgccauaagcuagucucagacggccaagcacuacccgaaauggaaauucaccuccaaaccaacgccgaaaaaggcaccauaacaauccaagacaccggaaucggcaugacccaagaggaacucguaagcaaccucggcacuaucgcgcgcucagggucaaaagcauuccuagacgcuuuacaaaaccaggccgaggcuucauccaaaauaaucggccaauucggcguaggcuucuacucagccuucauggucgcggaucgcgucgaagucuacucccgcagcgcagccccagggagccuaggguaccaguggcucagcgacggcuccggcguauucgaaaucgccgaagccuccggagucagaacaggaaccaaaaucauaauucaccugaaaucugacugcaaagaguucagcuccgaagcacgcguucgagacguagucacaaaauacuccaacuucgucuccuucccacucuaccucaacggaagacgcaugaacacccuccaggccaucuggaugauggaccccaaggacguccgugaauggcaacacgaagaguucuaccgauacguggcacaagcccacgauaaaccacguuacacccuacacuacaaaaccgacgccccacucaacaucagaagcaucuuuuacguccccgacaugaaaccgucaauguucgacgucucccgugaacuaggauccuccgucgcacucuacucacgcaaaguccuaauccaaacuaaagccacagacauccuucccaaauggcuccgguucauacgcggcgucguggacucagaagacaucccccuaaaccucucccgcgaacuacuccaagaauccgcgcuaauccgaaaacuuagagacguacuacaacaacggcuaaucaaauucuucaucgaccagaguaagaaagacgccgaaaaauacgcuaaauucuucgaagacuacggacuauucaugcgagaaggcaucgucaccgccaccgaacaagaagucaaagaagauaucgcaaaacuccuacgcuacgagucuuccgcccuacccucaggacaacuuaccucacuaagcgaauacgccagccgcaugcgcgcgggcacacggaauauauacuaccuaugcgcacccaaccgacaucucgccgaacacagcccauacuaugaagccaugaagaagaaagacacugaaguccuauucugcuucgaacaauuugaugagcucacccuacuacaccuccgggaauuugacaaaaagaaacuaauauccgucgagaccgacaucgucguagaccacuacaaagaggaaaaauucgaggaccgcuccccagcagccgagugccuaagcgaaaaagaaaccgaagaacuaauggccuggaugcgcaacguucuaggcucaagaguaaccaacguaaaaguaacccuacgacucgacacccaccccgccaugguaaccguacucgaaaugggagcagcccgccacuuccuacgaaugcaacaacucgccaaaacacaggaggaacgagcccagcuccuacagccaacacucgaaaucaacccccgacacgcacucaucaagaaacucaaccaacuccgggcauccgaaccaggacucgcccagcuccuaguagaccagaucuaugaaaacgccaugaucgcugcaggccuagucgacgacccaagagcaaugguuggacgacuaaacgaacugcucgucaaagcccucgagcgccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4706 - RNA, 809 nt, Artificial Sequence
  mRNA product Design3 comprising derived and/or modified sequence from Homo sapiens__NP_000609.1__HsIGF1 (opt9)
gggagagucccgcagucggcguccagcggcucugcuuguucgugugugugucguugcaggccuuauucaagcuuaccaugggcaaaaucuccucccuacccacccaacuauucaaaugcugcuucugcgacuuccuaaaagucaaaaugcacacaauguccucaucccacuuauucuaccucgcacucugccuccucacauucaccucauccgccaccgcaggccccgaaacccuaugcggcgccgaacucgucgacgcacuccaauucgucugcggcgaccgcggcuucuacuucaacaaacccacaggcuacggcuccuccucaagacgagcaccccaaaccggcaucguagacgaaugcuguuuccgaucaugcgaccuucgccgccucgaaauguacugcgcaccccucaaacccgccaaaucagcccgcuccguccgugcccaacgacacaccgacaugcccaaaacccaaaaagaaguccaccucaaaaacgccucccgcggcuccgcaggcaacaaaaacuaccgcauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4707 - RNA, 890 nt, Artificial Sequence
  mRNA product Design3 comprising derived and/or modified sequence from Homo sapiens__NP_000603.1__HsIGF2 (opt9)
gggagagucccgcagucggcguccagcggcucugcuuguucgugugugugucguugcaggccuuauucaagcuuaccaugggaauccccaugggcaaaucaaugcucguccuccucaccuuccucgccuucgccuccugcugcauagccgccuaccgacccuccgaaacacucugcggcggagaacucgucgacacccuacaauucgucugcggcgaccgaggcuucuacuucucccgacccgccucacgaguaucccgccgcucccgcggcaucgucgaagaaugcugcuuccgcucaugcgaccucgcccuccucgaaaccuacugcgccaccccagccaaauccgaacgagacgucuccaccccacccacaguacuucccgacaacuuuccccgauaccccguaggcaaauucuuccaauacgacaccuggaaacaaucaacccaacgacuccgccguggccuccccgcccuacuccgcgcacgccgcggacacguccuagcaaaagaacucgaagccuuccgcgaagccaaacgacaccgcccccucaucgcccuccccacccaagaccccgcccacggaggcgccccacccgaaauggccuccaaccguaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4708 - RNA, 986 nt, Artificial Sequence
  mRNA product Design3 comprising derived and/or modified sequence from Homo sapiens__NP_000591.1__HsIL6 (opt9)
gggagagucccgcagucggcguccagcggcucugcuuguucgugugugugucguugcaggccuuauucaagcuuaccaugaacuccuucuccaccuccgccuucggccccgucgccuucucccucggccuccuccucguccuccccgccgccuuccccgcccccgucccccccggcgaagacuccaaagacgucgcugccccccaccgccaaccccuaaccuccuccgaacgcaucgacaaacaaauccgcuacauccuagacggcaucucugcacuccgaaaagaaaccugcaacaaaucuaacaugugcgaauccuccaaagaagcccuagccgaaaacaaccucaacuuacccaaaauggccgaaaaagacggcugcuuccaauccggcuucaacgaagaaaccugccucgucaaaaucaucaccggccuccucgaauucgaagucuaccucgaauaccuacaaaaccgauucgaauccucagaagaacaagcccgagccguccaaauguccaccaaaguccucauccaauuccuccaaaaaaaagccaaaaaccucgacgccaucaccacaccugacccaaccaccaacgccucacuccucacaaaacuccaagcccaaaaccaauggcuccaagacaugacaacacaccucauccuccgcuccuucaaagaauuccuucaauccucccucagagcccuccgccaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4709 - RNA, 1628 nt, Artificial Sequence
  mRNA product Design3 comprising derived and/or modified sequence from Homo sapiens__NP_002183.1__HsINHBA (opt9)
gggagagucccgcagucggcguccagcggcucugcuuguucgugugugugucguugcaggccuuauucaagcuuaccaugccccuacucuggcuacgcggcuuccuacuagcaagcugcuggaucauaguaagaagcucacccaccccaggaagcgaaggacacagcgccgcgccagacugcccaucaugcgcacucgccgcccuccccaaagacguacccaacagccagcccgaaaugguagaagcagugaaaaaacacauacuaaacaugcuccaccuaaaaaagcgacccgacguaacccaacccgucccaaaagcagcacuacuaaacgcaaucagaaaacuccacguagggaaagucggcgaaaacggauacguagaaaucgaagacgacauaggaaggcgcgccgaaaugaacgaacucauggaacaaacgucggaaauaaucacauucgcagaaucagguacggccagaaaaacccuacacuuugagaucagcaaagaagggagcgaccuaagcgucgucgaaagagcagaggucuggcuguuccucaaaguuccaaaagccaacagaacacgcacaaaaguaacaauacgccuauuccagcaacaaaaacacccacaaggcagccuagacaccggagaagaggccgaggaaguaggacuaaaaggagaacggagcgaacuacuacuaagcgaaaaagucguagacgcccgcaaaagcacauggcauguauuccccguaagcagcuccauacaacgacuccuagaccaaggcaaaucaucacucgacguaagaaucgcgugcgaacaaugccaagaaagcggagccagccuuguacuacugggcaagaaaaaaaaaaaagaagaggaaggcgaagggaaaaaaaaaggcggcggagaaggaggcgccggagcagacgaagaaaaagaacaaagccacagacccuuccuaaugcugcaagcacgacagagcgaagaccacccccaccgcagacgccgacgcggacucgaaugcgacggaaaaguaaacaucugcugcaagaaacaauucuucgucagcuucaaggacauaggauggaacgacuggauaauagcaccgagcggcuaccaugcaaacuacugcgaaggcgaaugcccaagccacaucgcaggcacaagcggaagcagccuaagcuuccacagcaccgucaucaaccacuacagaaugcgaggacacagcccauucgccaaccugaaaagcugcugcgucccgacgaaacuaagaccaaugagcaugcuauacuacgacgacggccaaaacauaauaaagaaagacauacaaaacaugauaguagaagagugcggcugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4710 - RNA, 1571 nt, Artificial Sequence
  mRNA product Design3 comprising derived and/or modified sequence from Homo sapiens__NP_002184.2__HsINHBB (opt9)
gggagagucccgcagucggcguccagcggcucugcuuguucgugugugugucguugcaggccuuauucaagcuuaccauggacggccuccccggccgagcacuaggcgccgcaugccuccuccuacucgcagccggauggcuuggccccgaagcauggggcuccccaacaccaccucccacccccgcagcaccacccccacccccaccacccggcucccccggcggcagccaggacacaugcaccucaugcggcggcuuccgacgccccgaagaacucggccgcgucgacggagacuuccucgaagccguaaaacgccacauccuuucccgccuccaaaugcgaggccgacccaacaucacucaugccguccccaaagccgccauggucaccgcccuacgcaaacuccacgccggcaaaguccgagaagacggccgcgucgaaaucccccaccucgacggccacgccagccccggcgccgacggccaagaacgaguuuccgaaaucaucuccuucgccgaaaccgacggccuugcauccagccgaguacgccucuacuucuucaucucaaacgaaggcaaccaaaaccucuucguaguacaagccucccuuuggcucuaucucaaacuccuacccuacguacuagaaaaaggcucucgccgcaaaguaagagucaaagucuacuuccaagaacaaggccacggcgaccgauggaacauggucgagaaacgcgucgaccuaaaacgcuccgguuggcacacauucccccucaccgaagcaauccaagcccucuucgaacgaggggaacgccgccucaaccuagauguccaaugcgacagcugccaagaacuagccgucguccccgucuucgucgaccccggcgaggaaucccaccgacccuucgucgucguccaagcacgacucggcgacucucgccacagaauacguaaacgaggacucgaaugcgacggccgcaccaaccucugcugcagacaacaauucuucaucgacuuccgccucauuggauggaacgacuggaucauagcacccacuggauacuacggcaacuacugcgaaggcuccugccccgcauaccucgcaggaguccccggaagcgcauccucuuuccacaccgcaguagugaaccaauaccgcaugcgcggccucaaccccggaaccgucaacagcugcugcauccccaccaaacuuuccaccaugagcaugcucuacuucgacgacgaauacaacaucguaaaacgagacguccccaacaugauaguagaagaaugcggaugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4711 - RNA, 3806 nt, Artificial Sequence
  mRNA product Design3 comprising derived and/or modified sequence from Homo sapiens__NP_000623.2__HsITGAM (opt9)
gggagagucccgcagucggcguccagcggcucugcuuguucgugugugugucguugcaggccuuauucaagcuuaccauggcacuaaggguacuccuccucaccgcccucacacucugccacggauucaaccucgacacugaaaacgcaaugacauuccaagaaaacgcgcggggcuucggacaaucagugguccagcugcaagguagccgcgucgucgugggcgccccgcaagagaucguagcagccaaccagcgcggcucucuauaucaaugcgacuacucaacuggcaguugcgaacccaucagacuacaagucccagucgaagcugucaacaugagccuuggacuaucgcuagccgcaacaaccucgccuccucaacuccucgccugcggcccaaccguccaccagaccugcuccgagaauaccuacgucaaaggccucugcuuuuuguucggcucuaaccugcgccaacaaccgcaaaaauucccggaagcccugcgaggcugcccccaggaagacucagacauagcuuuccuaauugacggguccggcuccaucauaccccacgacuuccgucgaaugaaagaguucguaucaacuguaauggaacaacucaagaaaucuaaaacgcuguucucacucaugcaauacagcgaagaguucaggauccacuucaccuucaaagaguuccaaaacaacccaaacccacgcucgcucgucaagccaauaacccaacuccucggcagaacccauacagcuacaggcauccgaaaagucgucagagaacucuucaacaucaccaacggcgcccggaaaaaugccuucaaaauccuuguagucaucaccgacggugaaaaauucggcgauccucuuggauacgaagacguaauuccugaagccgacagagaaggagugauucgauacgucaucggagugggcgacgcauuccgcagugaaaagucccgacaagaacugaacaccaucgccuccaaaccuccccgagaccacguuuuccaaguaaacaacuucgaagcacucaagaccauccaaaaccaacugcgcgagaaaauauucgcaaucgaaggcacgcaaaccggguccaguucauccuucgaacacgaaaugucccaggaaggauuuuccgcagcgaucacuuccaacggacccuuacuauccacagucggcucguacgacugggccggcggcguauuccuauacaccagcaaagaaaaauccaccuucaucaacaugacccgggucgacagcgacaugaacgaugccuaccucggguaugcagccgcaauuauacuaaggaaccgcguucaaucccucguacugggagcaccccgcuaccagcacauaggccuaguggcuauguuccgucaaaacacaggcaugugggaauccaaugccaacguuaagggcacgcaaauaggagccuacuucggcgccucucuaugcuccguagacguagacuccaacggauccacagaccuaguacugaucggcgcaccccacuacuacgaacaaaccagaggcggacaagucucaguguguccacucccccgcggucgagcacgauggcaaugugaugccguccuauacggcgaacagggacaaccguggggccgcuuuggagcugcccucaccguccucggcgauguaaacggugacaaacucacugauguagccauaggcgcccccggagaagaggauaacagaggagccgucuaccuauuccacggcaccucaggaagcgggaucagcccaucccacucccaacgcauagcgggcucaaagcuaucgccucgccugcaguacuuuggccaaagccucuccggcggccaagaccucaccauggacggucuaguagaccucacaguaggagcccaaggacauguacuccuccuucgcucgcagcccguacucagaguaaaggccaucauggaauuuaauccaagagaagucgcccgaaacguauucgaaugcaacgaucaggugguuaaagguaaagaagccggugagguacgcguaugucuccacguacaaaaaucgacccgggacagacuucgcgaaggacaaauccaaucaguagucaccuacgaccucgcucuagacuccggucguccccauucacgagccguguucaacgaaaccaaaaacucuacaagacgccaaacucagguacucggcuugacacaaacuugugagaccuuaaaacuucagcugccaaacuguaucgaggaccccgucuccccaaucguacugcggcuuaacuucucucucgucggcacaccccuuuccgcguucgguaaccugagacccguccucgcagaagacgcccaacgacucuucaccgcacucuuccccuuugagaaaaacugcggcaacgacaacaucugccaagaugacuuaagcauuacauucucauuuaugagccuagacugucucguaguaggcggaccccgggaauuuaacgucacuguaaccgugcgcaacgacggugaagacuccuacaggacgcaagucacauucuucuucccccucgacuuaagcuaccguaaagucagcacccuucagaaccagcguucucaacgauccuggaggcuugcgugcgaaucagcuagcucaaccgaggucuccggcgcgcucaaauccaccucaugcuccaucaaccaccccaucuuccccgaaaacagcgaaguuaccuucaacauaaccuucgacguagacuccaaggcaucacuaggaaacaaacuccuccucaaggccaacguaaccuccgagaauaacaugccacgcacgaauaaaacagaguuccaauuggaacuccccguaaaauacgcgguauacauggucgucacuucucacggaguaucuaccaaauaccuaaacuuuacagccuccgaaaacacaagccgaguaaugcagcaucaauaccaagugucaaaccugggacaaagaucgcuaccuaucucacucgucuuccugguaccggucaggcuuaaccaaacggucauaugggaccgcccccaaguaaccuuuucagaaaaccucuccagcacaugccacaccaaagaaaggcucccaucacauagcgacuuccuagcagagcuccgcaaggcgcccgucguuaacugcuccauagcagugugccaacgcauccagugcgacauaccauucuuuggcauccaggaggaguucaacgcaacccucaagggaaaccucucuuucgacugguacauaaaaacuucccacaaucaccuccuaaucgucuccaccgcagaaauccucuucaacgacagcguauucacccuacuaccaggccagggagcguucguccggagccaaaccgaaaccaaaguggaaccauuugaaguacccaaccccuuaccccuaaucgucggguccucagucggcggccuacuacuucucgcuuuaaucaccgccgcccucuacaaacuaggcuuuuucaaaagacaauacaaagacaugauguccgaaggaggcccacccggggccgaaccgcaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4712 - RNA, 1751 nt, Artificial Sequence
  mRNA product Design3 comprising derived and/or modified sequence from Homo sapiens__NP_002415.1__HsMMP8 (opt9)
gggagagucccgcagucggcguccagcggcucugcuuguucgugugugugucguugcaggccuuauucaagcuuaccauguucagccucaaaacgcuccccuuccuccuacuccuccacguccaaauaucuaaagccuuucccgucuccucuaaagaaaagaacacaaaaacaguacaagacuaccuggaaaaauucuaccaacucccauccaaccaauaccagucaacccgcaaaaacggcaccaacguaaucgucgaaaaacucaaagaaaugcaacgcuucuucggacucaacgucacugguaaaccaaacgaagaaacccucgacaugaugaaaaagccgagaugcggcguaccagacuccggcggcuuuaugcucacccccggaaacccgaaaugggaacgcaccaaccucaccuaccgcauacgaaacuacacaccccaacucucugaagccgaagucgaacgugccaucaaagacgccuucgaacucuggucaguagccuccccacucauuuucacacgaaucucccaaggugaagccgacaucaacaucgccuucuaccaacgagaccacggcgacaauucccccuuugacggcccaaacggaauacuagcccacgccuuccaacccggucaaggcaucggcggcgacgcccacuucgacgcagaagaaaccuggaccaauaccuccgcaaacuacaaccucuuccucgucgcagcccacgaauuuggacacucacucggccucgcacacucuagcgaccccggcgcccucauguaccccaacuacgccuuccgagaaaccuccaacuacucacucccgcaagacgacaucgauggaauccaagccaucuacggccucuccuccaacccaauccaacccacuggccccucaacccccaaacccugugacccaucccucacauucgacgccauuaccacccuccgcggggaaauccucuucuucaaagaucgcuacuucuggcgccgacacccccaacuacaacgcgucgaaaugaauuucaucucccucuucuggcccucccucccuaccggcauucaagccgccuacgaagacuucgaucgcgaccuuauuuuucucuuuaaaggcaaccaauacugggcccucucgggcuacgacauccuacaaggauaccccaaagacaucuccaacuacggauuccccucuuccguccaagcuauagacgccgccgucuucuaccgauccaagacauacuucuucgucaaugaccaauucuggcgauacgacaaccaacgacaguucauggaacccggguaccccaaauccauuuccggagccuucccaggcaucgaauccaaagucgacgccgucuuccagcaagaacacuucuuccacgucuucucaggcccccgcuacuacgccuucgaccuaaucgcccaacgcgucacccgcgucgcccgaggcaacaaauggcucaacugcagauacggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4713 - RNA, 2471 nt, Artificial Sequence
  mRNA product Design3 comprising derived and/or modified sequence from Homo sapiens__NP_004985.2__HsMMP9 (opt9)
gggagagucccgcagucggcguccagcggcucugcuuguucgugugugugucguugcaggccuuauucaagcuuaccaugagccuguggcaaccccucguccucguccuucuuguccucgguugcuguuucgccgcaccccgccaacgacaguccacccucguccucuuccccggagaccuccgcacaaaccuaacugaccgccagcucgccgaagaauaucuuuaccgcuacggcuacacccgcgucgcagaaaugagaggcgaauccaaaucucuggggcccgcccuccuccuccuccaaaaacagcucucccuccccgagaccggagaacuugacuccgccacccucaaagcaaugcgaacaccacgcugcggcgucccagaccucggccgcuuccaaacguucgaaggcgaccuaaaauggcaucaucacaacauuaccuacuggauccaaaacuacuccgaagaccucccccgcgccguaauagacgacgccuucgccagagccuucgcgcucugguccgccgucaccccacuaacauucacccgcgucuacucacgcgacgccgacauagugauucaauucggugucgcugaacacggggacggcuaccccuucgacggaaaagacggccuacuggcccacgcauucccacccggacccggaauccaaggugacgcccacuuugacgacgacgagcuuuggucccuaggaaagggcgucguagucccaacacgcuucggaaacgcagacggcgccgcuugccacuuccccuucauauucgaaggaagguccuacucagcaugcaccaccgacggccgaucagacggccucccguggugcucgaccacagcgaacuacgacacagaugaccgcuucggcuucugccccucagaacgacuauacacccaggacggcaacgccgacggaaaacccugccaauucccauucauauuccagggucagagcuacuccgccuguacgacggacggcagaagcgauggcuaccgcuggugcgcaaccacagcgaacuacgaccgagacaaacuuuucgguuucuguccaacccgcgcagacuccaccguaaugggcggcaacagcgccggagaacuaugcgucuucccauucaccuuccucggaaaagaauacuccacuuguaccucggaaggcagaggcgacggaagacucuggugugcuacaaccucaaacuucgacuccgacaagaaauggggcuucugccccgaucaaggcuacagucuauuccucgucgcagcccacgaguucggacacgcccucgggcucgaccacuccuccguacccgaagcgcuaauguacccaauguacagguuuaccgaaggaccaccccuacacaaagacgacgucaacggaauccgccaccuuuacggcccccgccccgaacccgaaccucguccacccaccacaacaacaccccaacccaccgcaccgccaaccguaugucccacggggcccccuaccguccacccgagcgaaagacccacagcaggcccuaccgguccacccucagcaggacccacaggacccccuacugccggccccucuacagccacuacugucccccuaagcccaguugacgacgcaugcaacguaaacauauuugacgcaaucgccgaaaucggcaaccaacuuuaccuauucaaagacgguaaauacuggcgauucuccgaaggacgcggaagucgcccccagggcccauuccuaaucgcagacaaauggccagcccuaccgagaaaacuagauucagucuucgaagaaagacuaagcaagaaacucuucuucuuuucuggccgacaaguauggguauacacaggagccagcguacuaggccccagaagacucgacaaacuaggccuaggagcagacguugcacaaguaaccggagcucuccguuccggcagaggcaaaaugcuauuguucucuggccgcagacuuuggcgcuucgacgucaaagcucaaaugguagacccccgauccgcauccgaggucgaccgcauguuccccggcguccccuuagacacacacgacguuuuccaguaccgagagaaagccuacuucugccaagaccgcuucuacuggagaguaagcagcagguccgaacucaaccaaguagaccaagucggauacguaacauacgacauccuccaaugcccagaagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4714 - RNA, 1763 nt, Artificial Sequence
  mRNA product Design3 comprising derived and/or modified sequence from Homo sapiens__NP_002418.1__HsMMP13 (opt9)
gggagagucccgcagucggcguccagcggcucugcuuguucgugugugugucguugcaggccuuauucaagcuuaccaugcaccccggaguccucgccgcauuccuauuccucuccuggacccacugccgagcccuaccccucccauccggcggagacgaagaugaccucuccgaagaagaccuccaauucgcagaacgcuaccuucgcuccuacuaccacccaaccaaucucgcaggcauccuaaaagaaaacgccgcauccucaaugaccgaacgccuccgagaaaugcaauccuucuucggccucgaagucaccggcaaacucgacgacaacacccucgacguaaugaaaaaaccuagaugcggagucccagacgucggagaauacaacguauucccccguacccugaaauggucaaaaaugaaccucacguacaggaucguaaacuacacccccgacaugacccauagcgaagucgaaaaagccuucaaaaaagccuucaaagucugguccgacgucacuccacuaaacuucacccgucuccacgacggcauagccgacaucaugauauccuucggaaucaaagagcacggcgacuucuaccccuucgacggacccagcggucuccucgcacacgccuuccccccgggccccaacuacggcggagacgcccacuucgaugacgacgagaccuggacauccuccucaaagggcuacaaccucuuccucgucgccgcccacgaauucgggcacucacuuggacucgaccauuccaaagaccccggagcccucauguucccaaucuacacauacaccggcaaaagucacuucaugcuccccgacgacgacguccaaggaauucaaagccucuacggccccggcgaugaagaccccaaccccaaacaucccaaaacacccgacaagugcgacccuucccucagccucgacgcaaucaccucacucagaggcgaaaccaugauauucaaagaccgauucuucuggcgacuccacccgcaacaaguagacgccgaacuauuccuaaccaaauccuucuggccagaacuaccuaaccgaaucgacgccgccuacgaacaccccagccacgaccucaucuucaucuuccgcggcagaaaauucugggcccucaacggcuacgacauccucgaaggcuaccccaaaaaaauaucugaacucggccucccaaaagaagucaaaaaaauauccgccgccguccacuucgaagacaccggcaaaacccuacucuuuagcggcaaccaagucuggcgauacgacgacacgaaccacaucauggacaaagacuacccucgccucaucgaagaagacuucccaggaaucggcgauaaaguagacgcgguuuacgaaaaaaacggcuacaucuacuucuucaacggcccaauacaauucgaauacuccauaugguccaaccgaauagucagagugaugccagcaaauucaauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4715 - RNA, 1415 nt, Artificial Sequence
  mRNA product Design3 comprising derived and/or modified sequence from Homo sapiens__NP_001286.1__HsCCR1 (opt9)
gggagagucccgcagucggcguccagcggcucugcuuguucgugugugugucguugcaggccuuauucaagcuuaccauggaaacccccaacacaaccgaagacuacgacaccaccacggaguucgacuacggcgacgccacccccugccaaaagguaaacgaacgagccuucggcgcacaacuucucccaccccuguacucccuaguguucguaauaggccucgucggcaauauccuagucguauuaguccucguccaauacaaacgccucaagaacaugaccucuauauaccuacucaaccuagcaaucuccgaccuccuuuuccuguucacccuccccuucuggaucgacuauaaacucaaagacgauugggucuucggagacgccaugugcaaaauccucuccggcuucuauuauaccggucucuacuccgaaaucuucuucauaauccuccucaccaucgacagauaucucgccauaguccacgccgucuuugcacuccgcgcccgcaccgucaccuucggugucaucaccuccaucauaaucugggccuuagccauccucgccuccaugcccggacucuacuuuuccaaaacccaaugggaguucacccaccauaccugcucccuccacuucccccacgaaucccuacgcgaauggaaacucuuccaagcacuaaaacuaaaccucuuuggccucguccuuccccuccuagucaugaucaucugcuacacaggcaucaucaaaauccuacuucgucgcccuaaugaaaagaaauccaaagccguccgacucaucuucgucaucaugauaaucuuuuuccucuucuggacacccuauaaucucaccauccucaucucugucuuccaagacuuccucuucacacacgaaugcgaacaaucccgccaccuagaccucgccguccaagucaccgaagucaucgcauacacccacugcugcgucaaccccgucauauacgcauucgucggcgaacgcuuccgcaaguaccuccgccaacucuuccaccgacgcgucgcaguccaucucgucaaaugguuacccuuucucucugucgaccgccucgaacgcguauccucaacaucacccuccaccggcgaacaugaacuuucagccggcuucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4716 - RNA, 983 nt, Artificial Sequence
  mRNA product Design3 comprising derived and/or modified sequence from Homo sapiens__NP_002598.4__HsPDGFA (opt9)
gggagagucccgcagucggcguccagcggcucugcuuguucgugugugugucguugcaggccuuauucaagcuuaccaugcgaacccucgccugccuccuccuccucggcugcggcuaccucgcccacguacucgccgaagaagcagaaaucccccgcgaagucaucgaacgccucgcacgcucccaaauccacuccauccgugaccuccaacgacuccuggaaaucgacuccgucggauccgaagacucccuagacaccucccuaagagcccacggcguacacgccacaaaacacguccccgaaaaacgaccccuccccauccgcagaaaacgauccauagaagaagccguccccgccguaugcaaaacacgcacagucaucuacgaaauaccccgcucccaagucgacccaaccuccgccaacuuccuaaucuggccccccugcgucgaagucaaacgcugcaccggcugcugcaacaccuccucagucaaaugccaacccagccgcguccaccaccgcagcgucaaagucgcaaaagucgaauacguacgcaaaaaacccaaacucaaagaaguccaagucagacucgaagaacaccuagaaugcgcaugcgccaccaccagccuaaacccagacuaccgcgaagaagacaccggccgaccccgcgaauccggcaaaaaacgcaaacgcaaaagacuaaaacccaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4717 - RNA, 1073 nt, Artificial Sequence
  mRNA product Design3 comprising derived and/or modified sequence from Homo sapiens__NP_002599.1__HsPDGFB (opt9)
gggagagucccgcagucggcguccagcggcucugcuuguucgugugugugucguugcaggccuuauucaagcuuaccaugaaccgcugcugggcccuauuccuaagccuaugcugcuaccuccgccuagucucggccgagggcgaccccauccccgaagaacucuacgaaaugcucagcgaucacucaauccgcuccuucgacgaccuccaacgccuccuccacggcgaccccggcgaagaagacggagccgaacuagaccucaacaugacacgcucacacuccggaggggaacucgaaucccucgcacgcggccgccgcagccuaggcucacuaacaaucgccgaaccagcaaugaucgccgaaugcaaaacaagaacagaagucuucgaaaucucacgccgccuaaucgaccgcaccaacgccaacuuccuagucuggccacccugcgucgaaguccaaagaugcuccggaugcugcaacaacagaaacguccaaugccgccccacccaaguccaacuccgaccaguacaaguaagaaaaauagaaaucguccgcaaaaaacccaucuucaaaaaagcaaccguaacccucgaagaccaccucgcaugcaaaugcgaaaccgucgccgcagcccgccccgucacccgcagccccggcggaagccaagaacaacgagcaaaaacaccccaaaccagagucaccauccgaacaguccgcguacgcagaccccccaaaggaaaacaccgcaaauucaaacacacacacgacaaaaccgcccuaaaagaaacccuaggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4718 - RNA, 1385 nt, Artificial Sequence
  mRNA product Design3 comprising derived and/or modified sequence from Homo sapiens__NP_057289.1__HsPDGFC (opt9)
gggagagucccgcagucggcguccagcggcucugcuuguucgugugugugucguugcaggccuuauucaagcuuaccaugucccucuucggccuacuccuccuaacaucugcacucgccggccaacgccaaggcacccaagccgaauccaaccucagcucuaaauuccaauucuccucaaacaaagaacaaaacggcguccaagacccccaacacgaacgcauaaucacagucucaaccaacggcuccauccauucaccccguuucccccacaccuacccccgcaacaccguccuaguauggcgccuaguagcaguagaggaaaacgucuggauccaacucaccuucgacgaacgcuuuggacucgaagauccagaagacgauaucugcaaauacgacuucgucgaaguagaagaaccuuccgacggcacaauccuaggccgauggugcggcuccggcaccgucccaggcaaacaaauauccaaaggcaaccaaauccgcauccgcuucgucuccgacgaauacuuccccuccgaacccggcuucugcauccacuacaacaucgucaugccccaauucaccgaagccgucucccccuccguccucccacccuccgcacucccccuagaccugcucaacaacgccaucaccgccuucucaacccucgaggaccucauacgcuaccuagagcccgaacgcuggcaacucgaccucgaagaccucuaccgcccaacauggcaacuccucggcaaagccuucgucuucggccgcaaaucccgcguagucgaccuaaaccuacuaaccgaagaaguacgccucuacagcugcacaccacgcaacuucucagucuccauccgcgaagaacucaaacgcaccgacaccaucuucuggccaggcugccuccuaguaaaacgcugcggcgggaacugcgccugcugccuccacaacugcaacgaaugccaaugcgucccauccaaagucaccaagaaauaccacgaagugcuacaacuaagaccaaaaaccggcguccgcggacuccacaaaucucucaccgacguagcccuagaacaccacgaagaaugcgacugcgucugccgcggcuccaccggcggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4719 - RNA, 1442 nt, Artificial Sequence
  mRNA product Design3 comprising derived and/or modified sequence from Homo sapiens__NP_149126.1__HsPDGFD (opt9)
gggagagucccgcagucggcguccagcggcucugcuuguucgugugugugucguugcaggccuuauucaagcuuaccaugcaccgccucauauuugucuacacacugauaugcgccaacuucuguucaugccgcgacaccuccgccaccccccaaucugccuccauaaaagcccucagaaacgccaaccuacgacgcgacgaccucuaccgacgcgacgaaacaauacaagucaaaggcaacggcuacguacaauccccacgcuuccccaacuccuacccccgcaaccuccuccucaccuggcggcuacacucccaagaaaacacccgcauacagcuuguauucgacaaccaauucggccuagaagaagccgagaacgacaucugccgauacgacuucgucgaagucgaagacaucagcgaaaccuccaccaucaucagaggaagauggugcggccacaaagaaguccccccucgaaucaaaucccgcacaaaccagauaaaaauaacauucaaauccgacgacuacuucgucgccaaacccggcuucaaaaucuacuacucccuccucgaagauuuccaacccgccgccgccuccgaaacaaacugggaauccgucaccuccuccauauccggugucucauacaacuccccaagcgucacagacccaacccucauugcagacgcacuagacaaaaaaaucgccgaauucgacaccgucgaggaccuccuaaaauacuucaaccccgaauccuggcaagaagaccucgaaaacauguaccucgacacaccccgcuacagaggccgcuccuaccacgaccgcaaauccaaggucgaccucgaccgccucaacgacgacgccaaacgcuacagcugcacaccccgcaauuacagugucaacaucagagaggaacuaaaacuagccaacguagucuucuucccacgcugccuacuaguacagcgaugcggcggcaacugcggcugcggcaccgugaacuggcgguccugcaccuguaacuccggcaaaacaguaaaaaaauaucacgaaguccuacaguuugaacccggacacaucaaacgccguggccgcgccaaaacuauggcccucguugacauccaacucgaccaccacgaacgcugcgacugcauaugcucuucccgcccaccccgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4720 - RNA, 1025 nt, Artificial Sequence
  mRNA product Design3 comprising derived and/or modified sequence from Homo sapiens__NP_003946.3__HsSOCS3 (opt9)
gggagagucccgcagucggcguccagcggcucugcuuguucgugugugugucguugcaggccuuauucaagcuuaccauggucacccauucaaaauuccccgccgccggcaugucccgcccccucgacaccucccuccgccucaaaacauucuccuccaaauccgaauaccaacucgucgucaacgccguccgcaaacuccaagaauccggcuucuacuggucugccgucaccggaggcgaagccaaccuccuacuaucagccgaaccagcuggcaccuuccuaauccgugacuccuccgaccaacgccacuucuucacccucucagucaaaacccaauccggcaccaaaaaccuccgcauccaaugcgaaggcggauccuucucccuacaauccgacccccgcucaacucaaccagucccccgauucgacugcguccucaaacucguccaccacuacaugcccccacccggagcccccuccuuccccuccccacccaccgaacccuccuccgaaguccccgaacaacccuccgcccaaccccuccccggaucaccaccccgccgcgccuacuacaucuacuccggcggcgagaaaaucccccuaguccucucccgcccacucucauccaauguugccacccuacaacaccucugccguaaaaccguaaacggacaccuagacuccuacgaaaaaguuacccaacuacccggccccauccgcgaauuucucgaccaauacgaugcaccccucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4721 - RNA, 830 nt, Artificial Sequence
  mRNA product Design3 comprising derived and/or modified sequence from Homo sapiens__NP_003227.1__HsTGFA (opt9)
gggagagucccgcagucggcguccagcggcucugcuuguucgugugugugucguugcaggccuuauucaagcuuaccaugguccccuccgccggccaacuagcccucuucgcccuaggcaucguccucgcagccugucaagcacucgaaaacuccaccuccccccucucagccgacccacccguagccgcagccguagucucccacuucaacgacugccccgacucccacacccaauucugcuuccacggaaccugccgauuccucguccaagaagacaaacccgccugcguaugccacuccggcuacgucggcgcccgcugcgaacacgccgaccuccuagccguaguagccgccucacaaaaaaaacaagccauaaccgcacucguagucgucuccaucgucgcccucgccguccuuauaauaaccugcguccucauccacugcugccaaguacgcaaacacugcgaauggugccgcgcccucaucugcagacacgaaaaacccuccgcacuacucaaaggccgcaccgccugcugccauuccgaaaccguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4722 - RNA, 1520 nt, Artificial Sequence
  mRNA product Design3 comprising derived and/or modified sequence from Homo sapiens__NP_000651.3__HsTGFB1 (opt9)
gggagagucccgcagucggcguccagcggcucugcuuguucgugugugugucguugcaggccuuauucaagcuuaccaugccaccauccggccuacgucuccucccucuccuccugccacuccucuggcuauuaguccuaacaccaggccgcccagccgccggccucucaaccugcaaaacuaucgacauggaacuugucaaacgcaaacgaauagaagccauccgcggccaaauccuauccaaacuccgccucgccuccccacccucacaaggcgaaguaccacccggaccccuacccgaagccguccuugcacucuauaacuccacccgcgaccgaguugcuggagaaucagccgaacccgaaccagagccagaagccgacuacuacgccaaagaagucacccgcguacucauggucgaaacacacaacgagauauacgauaaauucaagcaauccacccacuccauauacauguucuucaacaccucagaacuacgagaagccguccccgaacccguccuacuaucacgagccgaacuucgucuccuccgacucaaacucaaggucgaacaacacgucgaacucuaccaaaaauauucaaacaacucauggcgcuaccuaucaaaccgccuacuagcaccaucagacucacccgaauggcuaucauucgacgucaccggagucguccgccaauggcuaucacgaggaggcgaaaucgaaggcuucagacucucagcccacugcuccugcgacucccgagacaacacccuccaagucgacaucaacggcuucaccaccggccgacgcggagaccucgccacaauacacggaaugaaccgacccuuccuacuccucauggcaacaccacucgaacgcgcccaacaccuccaaucuucccgccaccgccgagcccuggacaccaacuacugcuucuccuccacugagaaaaauugcugcgugagacaacucuacaucgacuuccgcaaagaccucggcuggaaauggauccacgaaccaaaaggcuaccacgcaaacuucugccucggccccugcccauacauauggucccuagacacccaauacuccaaaguucuagcccuauacaaccaacacaaccccggcgccuccgcggcucccugcugcguuccccaagcccucgaaccccucccaauagucuacuacgucggccgcaaaccaaaagucgaacaacucuccaacaugaucguccgauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4723 - RNA, 1592 nt, Artificial Sequence
  mRNA product Design3 comprising derived and/or modified sequence from Homo sapiens__NP_003229.1__HsTGFB2 (opt9)
gggagagucccgcagucggcguccagcggcucugcuuguucgugugugugucguugcaggccuuauucaagcuuaccaugcacuacugcguacucucagccuuccucauccuccaccucgucaccgucgcacuaucacuaucuaccugcagcacacucgauauggaccaauucaugcgcaaacgcauagaagcuauccguggccaaauccuauccaaacucaagcucaccagcccacccgaagacuauccugaacccgaagaagucccacccgaaguaaucuccaucuacaacuccacacgcgaccuccuacaagaaaaagccucccgacgcgcagccgccugcgaacgagagcgcuccgacgaagaauacuacgccaaagaaguauacaagauagacaugccacccuucuucccuuccgaaaacgccauacccccaaccuucuaccgcccauacuuccgcaucguccgcuucgacgucucugcuauggagaaaaaugcauccaaccucgucaaagccgaguuccgcguauuccgccuacaaaaccccaaagcgcgcgucccugaacaacgcaucgaacucuaccagauccucaaauccaaagaucuuaccucgcccacacaacgcuacaucgacuccaaagucguaaagacccgcgccgaaggagaauggcucuccuucgacguaaccgacgccguccacgaauggcuacaccacaaagaccgcaaccucggcuucaaaaucucccuacacugccccugcugcaccuucguccccuccaacaauuacaucauccccaauaaauccgaagaacucgaagccagauucgccggcaucgacggcaccucaaccuacacauccggcgaccagaaaaccaucaaaucaacccgcaagaaaaacuccggcaaaaccccacaucuccuccucaugcuucucccuucauaccgucucgaaucucaacaaaccaaccgacgcaagaaacgcgcccucgacgccgccuacuguuuccgcaacguccaagacaacugcugccuacgaccccucuacauagacuucaaacgcgaccucggcuggaaauggauccacgaacccaaaggcuacaacgcuaacuucugcgcgggcgccugccccuaccuaugguccuccgacacccaacacucacgcguccucucccucuacaacaccaucaauccugaagccuccgccucacccugcugcgucucccaagaccucgaaccacucaccauacuauacuacaucggcaaaacgccuaaaauagaacaacuaucuaacaugaucgucaaauccuguaaaugcagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4724 - RNA, 1586 nt, Artificial Sequence
  mRNA product Design3 comprising derived and/or modified sequence from Homo sapiens__NP_003230.1__HsTGFB3 (opt9)
gggagagucccgcagucggcguccagcggcucugcuuguucgugugugugucguugcaggccuuauucaagcuuaccaugaaaaugcaccuccaacgcgcccuagucguacucgcacuacucaacuuugccaccguaucacuuucacucuccacaugcaccacacucgacuuuggccacaucaaaaagaaacgagucgaagcuauacgaggccaaauccuaucaaaacuacgccucacauccccacccgaacccacaguaaugacccacguccccuaccaaguacucgcccuauacaacuccacccgcgaacuccuagaagaaaugcacggagaaagagaagaaggaugcacccaggaaaacaccgaaucagaauacuacgccaaagaaauacacaaauucgacaugauccaaggccucgccgaacacaacgaauuagccgucugccccaaagguaucacuagcaaaguauuccgauucaacguuuccucggucgagaaaaaccgcaccaaccuauuccgagccgaguuccguguccuccgcguccccaacccaagcucaaaacgcaacgaacaacgcaucgaacuuuuccaaauacuaagacccgacgaacacaucgccaaacaacgcuacauaggcggcaaaaaccucccaacccgcggcaccgcagaauggcucucuuucgacgucaccgacaccguacgugaauggcuacucagacgcgaauccaaccuaggucuagaaaucucaauacacugccccugccacaccuuccaaccaaacggagacauccucgaaaacauccacgaagucauggaaaucaaauucaaaggagucgacaaugaagacgaccacggacgaggcgaccucggacgacucaaaaagcaaaaagaccaccacaacccccaccucauccuaaugaugaucccaccccaccgccucgacaaccccggacaaggcggccaacgcaagaaacgcgcccucgacaccaacuacugcuuccgcaaccuagaagaaaacugcugcguacgcccccucuacaucgacuuccgacaagaccuaggcuggaaauggguccacgaacccaaaggauacuacgcaaauuucugcagcggaccaugcccauaccuacgguccgccgacacaacccacuccacaguccuaggacuuuauaacacccuaaacccagaagccuccgccucccccugcugugucccccaagaccuugaaccucucaccauccuuuacuacgucggcagaacccccaaagucgaacaacuauccaacauggucgucaaauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4725 - RNA, 1733 nt, Artificial Sequence
  mRNA product Design3 comprising derived and/or modified sequence from Homo sapiens__NP_001057.1__HsTNFRSF1B (opt9)
gggagagucccgcagucggcguccagcggcucugcuuguucgugugugugucguugcaggccuuauucaagcuuaccauggcacccguugcagucugggcagcccuugccgucggccucgaacucugggccgcugcccacgcccuccccgcccaaguugccuucacuccuuacgccccagaaccaggcuccacaugccgacuccgagaauacuaugaccaaacagcccaaaugugcugcuccaagugcucccccggccaacacgccaaagucuucuguaccaaaaccucugacaccgucugcgacuccugcgaagacuccacuuacacccaacuauggaacuggguacccgaaugccucuccugcggcuccagaugcucauccgaccaagucgaaacccaagcaugcacacgcgaacaaaaccgaaucugcacaugcaggcccggaugguacugcgcacucuccaaacaagaaggcugccgccucugcgcaccccuccgaaaaugccgaccaggcuucggcgucgcccgcccaggaacagaaaccuccgacguagucugcaaacccugcgccccuggcacuuucuccaacacaaccagcucaaccgacauaugccgcccacaccaaaucugcaacgucguugcaauacccggcaacgcauccauggacgccgucugcaccuccacaucgcccacccgauccauggcacccggcgccguccaccucccccaaccugucucaacccgaucacaacacacacaacccacccccgaacccucaaccgccccauccaccucauuccuucuacccaugggccccuccccacccgccgaaggcuccaccggagacuucgcccucccagucggccuaaucgucggcgucaccgcccuaggccugcucaucaucggagucgucaacugcguaaucaugacccaagucaaaaagaagccccuaugucuccaaagagaagcaaaaguaccucaccuccccgccgacaaagcccgcggcacacaaggccccgaacaacaacaccuccuaaucaccgccccaucauccuccucaucaagccucgaaucaucagcaucagcucucgaccgccgcgccccaaccagaaaccaaccccaggccccaggcguagaagccuccggagccggagaagcccgagccucaacaggcuccuccgacagcucucccggcggccacggcacacaaguaaacguaaccugcaucgucaauguaugcucgucauccgaccauuccucccaaugcucaagccaagccucaucaaccaugggcgacaccgacucaagcccaucugaaucccccaaagacgaacaaguacccuucaguaaagaagaaugugccuuccgaucccaauuagaaacccccgaaacacuccuaggauccaccgaagaaaaacccuuaccccucggugucccagacgccggcaugaaacccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4726 - RNA, 860 nt, Artificial Sequence
  mRNA product Design3 comprising derived and/or modified sequence from Homo sapiens__NP_002623.2__HsPGF (opt9)
gggagagucccgcagucggcguccagcggcucugcuuguucgugugugugucguugcaggccuuauucaagcuuaccaugccggucaugcgcuuguucccgugcuuucuacagcucuuggcagggcucgcacucccagccgugcccccgcaacagugggcguuaucggccgggaacgggagcucggaaguggaagugguaccguuccaggaagugugggggcgcucguacugucgcgcgcuagagcgccuggucgaugucgugagugaguacccgagcgaggucgagcacauguucucgcccucaugcgugagcuugcucaggugcacgggcuguugcggggacgagaaccugcacugugucccggucgagaccgcgaacgugaccaugcaauugcucaagaucaggagcggggacaggcccucguacguggaauugaccuucagccagcacguacgcugugaaugucgcccacucagggaaaagaugaagccagaacgcaggcgaccgaaagggcgcgggaaaaggcgcagagaaaagcaaaggcccacagacugucacuuaugcggggacgcggucccgaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4727 - RNA, 1586 nt, Artificial Sequence
  mRNA product Design3 comprising derived and/or modified sequence from Homo sapiens__NP_001020537.2__HsVEGFA (opt9)
gggagagucccgcagucggcguccagcggcucugcuuguucgugugugugucguugcaggccuuauucaagcuuaccaugacagaccgccagacagacaccgcgccaucgcccucguaccaccuccugcccgggagaaggcgcacggucgacgccgcagccucgcgaggacaagggcccgagccagcgccaggaggcgggguagagggcgugggagcgcgaggggucgcgcucaaacucuucguccagcuucugggcugcagcagguucgggggcgcaguagugcgcgcaggcgaagccgagcccucaggcgcggccaggagcgcaagcucaggcagagaggaaccccagcccgaggagggggaagaagaagaggaaaaagaagaagaaagggguccacaauggcgccugggcgcgcgcaagccaggaaguuggaccggagaagcagcagugugcgcggacucugcaccagccgcgcgagcgccccaggcauuggccagagcaucaggcagaggaggacgaguggcaagaagaggagccgaggaaucaggaccgccccauagcccaagcaggcgagggagugcgagcagagccggaccagggcgcgcaagcgagacaaugaacuuccuccugagcuggguacacuggucgcuagcacuguugcucuaccuccaucacgcaaaauggagccaggccgcgccaauggccgagggaggaggacaaaaccaccacgagguagugaaauucauggacgucuaccaaaggagcuauugccaccccauagaaacgcuaguggacauauuccaggaauauccagacgaaauagaguacauauucaaaccaagcugcgugccgcucaugaggugcggcggaugcuguaacgaugaagggcuagagugcguacccacggaagagagcaacaucaccaugcagaucaugaggauaaaaccgcaccagggccagcacauaggagagaugucauuccugcaacacaacaagugcgagugccggcccaagaaagaccgagcaagacaggaaaagaaaucaguaaggggaaagggcaagggacagaaaagaaaaagaaagaagaguagguacaagagcuggaguguauacguaggggcgagaugcugccugaugccauggagccuaccgggaccgcacccaugcggacccugcagcgaacgcaggaaacaccuguucguccaggacccacaaacaugcaaguguucaugcaagaacacagacucgcgcuguaaagcacgccaacucgagcuuaacgaaaggacaugccgcugcgacaaacccaggagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4728 - RNA, 1046 nt, Artificial Sequence
  mRNA product Design3 comprising derived and/or modified sequence from Homo sapiens__NP_001165094.1__HsVEGFA (opt9)
gggagagucccgcagucggcguccagcggcucugcuuguucgugugugugucguugcaggccuuauucaagcuuaccaugaacuuccuacucagcuggguccacuggucacucgcccuccuccucuaccuccaccacgccaaauggucccaagccgcccccauggccgaaggcggcggccaaaaccaccacgaaguaguaaaauucauggacguauaccaacgcagcuacugccaccccaucgaaacccuaguagacaucuuccaagaauaccccgacgaaaucgaauacauauucaaacccuccugcgucccacucaugcgcugcggcggcugcugcaacgacgaaggccucgaaugcguccccacagaagaaagcaacaucacaaugcagauaaugcgaaucaaaccccaccaaggccagcacaucggcgaaaugucauuccuccaacacaacaaaugcgaaugccgaccaaaaaaagaccgcgcaagacaagaaaaaaaauccgucagaggcaaaggcaaaggccaaaaacgaaaacgcaaaaaaucccgcuacaaaagcuggucagucuacguaggcgcccgcugcugccucaugccauggucccuccccggcccccaccccugcgggcccugcagcgaacgccgcaaacaccucuucguccaagacccacaaaccugcaaaugcuccugcaaaaacaccgacucccgcugcaaagcccgccaacucgaacuaaacgaacgcaccugccgcugcgacaaaccccgaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4729 - RNA, 971 nt, Artificial Sequence
  mRNA product Design3 comprising derived and/or modified sequence from Homo sapiens__NP_003368.1__HsVEGFB (opt9)
gggagagucccgcagucggcguccagcggcucugcuuguucgugugugugucguugcaggccuuauucaagcuuaccauguccccccuccuccgccgacuccuacuagccgcccuccuacaacucgcccccgcacaagcccccgucucccaacccgacgcccccggccaccaacgcaaagucguauccuggauagacguauacacccgcgccaccugccaaccacgagaagucguagucccacucacagucgaacucaugggcaccgucgcaaaacaacucguaccaucaugcguaaccguccaacgaugcggcggcugcugccccgacgacggccuagaaugcguccccaccggccaacaccaagucagaaugcaaauccucaugauccgcuaccccuccucccaacucggcgaaaugucacucgaagaacacucccaaugcgaaugccgccccaaaaaaaaagacucagccguaaaacccgaccgcgccgccacaccacaccaccgaccccaaccccgcucagucccaggcugggacuccgcccccggcgcacccucccccgccgacaucacccaccccacccccgcacccggccccuccgcacacgccgccccauccaccaccuccgcccucacccccggccccgccgccgccgccgccgacgccgccgccagcuccgucgcaaaaggcggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4730 - RNA, 1607 nt, Artificial Sequence
  mRNA product Design3 comprising derived and/or modified sequence from Homo sapiens__NP_005420.1__HsVEGFC (opt9)
gggagagucccgcagucggcguccagcggcucugcuuguucgugugugugucguugcaggccuuauucaagcuuaccaugcaccuccucggauucuucuccgucgccugcucccuacucgccgccgcacuccuccccggcccacgcgaagcaccagcagccgccgccgcauucgaaucaggccucgaccuauccgacgccgaaccagacgccggcgaagccaccgccuaugcaagcaaagaccucgaagaacaacuacgauccguaucauccguggacgaacuaaugaccguccucuacccagaauacuggaaaauguacaaaugccaacuccgaaaaggcggauggcaacauaaccgcgaacaagccaaccucaacagccgaaccgaagaaacaaucaaauucgccgccgcccacuacaacacggaaauacuaaaauccaucgacaacgaauggagaaaaacacaaugcaugccccgugaagucugcaucgacgucggcaaagaauuuggcgucgccaccaacacauucuucaaaccacccugcgucucaguauaccgaugcggcgggugcugcaacuccgaaggccuacaaugcaugaacaccuccaccucauaccucucaaaaacccucuucgaaauaacaguuccacucagccaaggccccaaacccgucacgauauccuucgcaaaccauacuucaugccgcugcaugucaaaacuugacguauaccgccaaguccacuccaucauccgaagaucacuacccgccacccuaccccaaugucaagccgccaacaaaaccugccccaccaacuacauguggaacaaccacauuugccgcugccuagcccaagaagacuucauguucucaucggacgccggcgacgacucaaccgacggcuuccacgacauaugcggccccaacaaagaacuagacgaagaaacaugccaaugcgucugccgcgccggccuccgacccgcauccugcggaccccacaaagaacuggaccgcaacucaugccaaugcgucugcaaaaacaaacucuuccccucccaaugcggcgcaaaccgcgaguucgacgaaaauaccugccaaugcgucugcaagcgaaccugcccacgcaaccaaccccucaaccccggaaagugcgccugcgaaugcaccgaaagcccacaaaaaugccuucucaaaggaaagaaauuccaccaccaaaccugcucaugcuaccgccgccccugcaccaaccgccaaaaagccugcgaacccggcuucucauacuccgaagaaguaugccgcugcguuccaagcuacuggaaacgcccccaaauguccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4731 - RNA, 1412 nt, Artificial Sequence
  mRNA product Design3 comprising derived and/or modified sequence from Homo sapiens__NP_004460.1__HsVEGFD (opt9)
gggagagucccgcagucggcguccagcggcucugcuuguucgugugugugucguugcaggccuuauucaagcuuaccauguaccgagaauggguagucgucaacgucuucaugaugcucuacguccaacugguccaagguucauccaacgaacauggccccgucaaacgcuccucccagagcacccucgagcgcuccgaacaacaaauccgcgcugccuccucucuagaagaacuucuccgaaucacccacucugaagacuggaaauuauggcgaugccgccuacgucucaagagcuucaccucaauggacucccgauccgcaucccaccgcucuacacgauucgccgccaccuucuacgacaucgaaacccucaaagucauagacgaagaauggcaacgcacccaaugcuccccaagggaaaccugcgucgaaguagccuccgaacucggcaaauccaccaacacauucuucaaaccucccugcgucaacgucuuccgcugcggcggcugcugcaacgaagaaucccucaucugcaugaacacauccaccuccuacauauccaaacaacuauucgaaauuucugucccccucaccucgguccccgaacucguccccgucaaaguagccaaccacaccggcugcaaaugccugcccaccgccccacgacaccccuauuccaucauccgacgcuccauacagauucccgaagaagaccgaugcucccacucaaagaaacucugccccauagacaugcuaugggacucaaacaaaugcaaaugcguccuccaagaagaaaacccacucgccggcacugaagaccacucgcaccuccaagaacccgcccucugcggaccccacaugauguucgacgaagaccgcugcgaaugcgucugcaaaaccccaugccccaaagaccucauccaacaccccaaaaacugcucaugcuucgaaugcaaagaaucccucgagaccugcugccaaaaacacaaacucuuccaccccgauaccugcuccugcgaagaccgcugccccuuccacacacgcccaugcgccuccggcaaaaccgcaugcgcaaaacacugccguuucccaaaagaaaaacgcgccgcccaaggcccccacucccgcaaaaaccccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4732 - RNA, 977 nt, Artificial Sequence
  mRNA product Design3 comprising derived and/or modified sequence from Homo sapiens__NP_061986.1__HsFGF21 (opt11)
gggagagucccgcagucggcguccagcggcucugcuuguucgugugugugucguugcaggccuuauucaagcuuaccauggacuccgacgaaaccggcuucgaacacucaggccucugggucuccguacuagccggccuccuccucggcgccugccaagcccaccccauccccgacuccucaccccuccuacaauucggcggccaaguccgccaacgcuaccuauacaccgacgacgcccaacaaaccgaagcccaccucgaaauccgcgaagacggcaccgucggcggcgccgccgaccaaucccccgaaucccuacuacaacucaaagcccucaaaccuggagucauccaaauacucggcgucaaaaccucccgcuuccucugccaacgccccgacggagcccucuacggcucccuccacuucgacccagaagccugcucuuuccgagaacuccucuuagaagacggcuacaacgucuaccaaucugaagcccacggccucccccuucaccuccccggaaacaaaucaccccaccgcgaccccgcaccccgcggcccagccagauuccucccccuccccggccucccaccagcccuccccgaaccacccggcauccucgcaccccaaccacccgacgucggcuccuccgacccccucucaauggucggccccucccaaggccgcucccccucauacgccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4733 - RNA, 1757 nt, Artificial Sequence
  mRNA product Design3 comprising derived and/or modified sequence from Homo sapiens__NP_002412.1__HsMMP1 (opt11)
gggagagucccgcagucggcguccagcggcucugcuuguucgugugugugucguugcaggccuuauucaagcuuaccaugcacagcuucccaccccuccuccuccuccuguucuggggcgucgucucacacuccuuucccgcuacccucgaaacccaagaacaagacgucgaccucguacaaaaguaccucgaaaaauacuacaaccuuaaaaacgacggccgucaagucgaaaagcgccgcaacucaggccccgucguugaaaaacucaaacaaaugcaagaauuuuucggccugaaagucacaggaaaacccgacgccgaaacccucaaagucaugaaacaaccccgcugcggaguccccgacguagcccaauucguccuaaccgaaggcaacccccgcugggaacaaacccaccucacauaccgcaucgaaaacuacacccccgaccuuccccgcgccgacgucgaccacgccauagaaaaagcauuccaauuaugguccaacgucaccccacucaccuucacuaaggucuccgaaggccaagcagacauaaugaucucuuucguccgcggcgaccaccgagacaacucccccuucgacggccccggaggcaaccuggcccacgcauuccaaccaggccccggcaucggaggagacgcccacuucgacgaagacgaacgcuggacaaacaauuucagagaauacaacuuacaucgcgucgccgcccacgaacucggccacagccucggccucucacacuccacagauaucggcgcccuaauguaccccuccuacaccuucuccggcgacguccaacuagcccaagacgacauagacggcauccaagccauauacggccgaucccaaaaccccguacagcccaucggaccacaaacucccaaagccugcgacuccaaacucaccuucgacgccaucaccacaauacgaggcgaagugauguucuucaaagacagauucuauaugagaaccaacccguucuaccccgaagucgaacuuaacuucaucucagucuucuggccacaacuaccaaacggccucgaagcagccuacgaauuugccgaccgcgacgaaguccgauucuucaagggcaacaaauacugggccguccaaggccaaaacguccugcacggcuacccaaaagacaucuauuccagcuucggcuucccacgcacugucaaacauaucgaugccgcccucagcgaagaaaacacaggcaaaacauacuucuucgucgcuaacaaauacuggcgcuacgaugaauacaaacgcuccauggacccaggcuauccuaaaaugaucgcccacgacuuccccggcaucggccacaaggucgaugccgucuucaugaaggacggauucuucuacuucuuccacggaacccgccaauacaaguucgaccccaaaacuaagcgaauccucacccuccaaaaagccaacuccugguucaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4734 - RNA, 1517 nt, Artificial Sequence
  mRNA product Design3 comprising derived and/or modified sequence from Homo sapiens__NP_002412.1__HsMMP1(1-19,100-469) (opt11)
gggagagucccgcagucggcguccagcggcucugcuuguucgugugugugucguugcaggccuuauucaagcuuaccaugcauucauucccaccacuacuacuccuccuauucuggggagucgucucccauuccuucguccucacagaaggcaacccccgcugggaacaaacccaccucaccuaccgcauagaaaacuacaccccagaccucccccgcgccgacgucgaccacgccaucgaaaaagcguuccaacuauggucuaacguaacaccccucaccuucaccaaagucuccgaaggccaagccgacauaaugaucucauucgucagaggcgaccaccgcgacaacucucccuucgacggccccggaggcaaccucgcacacgccuuccaacccggccccggaaucggcggcgacgcccacuucgacgaagacgaacgcuggaccaacaacuuccgagaauacaaccuccaccgcgucgccgcacacgaacucggccacagccucgggcucucacacuccaccgacaucggugcccucauguaccccucauacacauucucuggcgacguccaacucgcacaagacgacaucgacggcauccaagccaucuacggccgaucccaaaacccaguccaacccauaggcccacagacacccaaagcaugcgacuccaaacucaccuucgacgccauaaccaccauccgcggcgaaguaauguucuucaaagacagauucuacaugcgcaccaaccccuucuacccagaaguugaauuaaacuucaucuccgucuucuggccacagcucccaaacggucucgaagccgcauacgaauuugcagaccgagacgaaguacgauucuucaaaggcaacaaauauugggccguacaggggcaaaauguccuccacggcuacccuaaagacaucuacuccuccuucggcuucccccgcacagucaaacacaucgacgccgcccucuccgaagaaaacaccggcaaaaccuacuucuucgucgccaacaaauacuggcgauacgacgaauacaaacgcuccauggaccccggauaccccaaaaugaucgcccacgacuuccccggcaucggccacaaaguagacgccguuuucaugaaagacggauucuucuacuucuuccacggaacaagacaguacaaauucgacccaaagaccaaacggauccucacccuccaaaaagcaaacuccugguucaauugccgcaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4735 - RNA, 3704 nt, Artificial Sequence
  mRNA product Design3 comprising derived and/or modified sequence from Clostridium histolyticum__BAA77453.1__ColG (opt11)
gggagagucccgcagucggcguccagcggcucugcuuguucgugugugugucguugcaggccuuauucaagcuuaccaugaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgccgaacgaggagaacagcaagaagguggaggacuccaagaacgacaaggucgagcacgugaagaacaucgaggaggccaagguggagcaggucgcccccgaggucaagagcaaguccacgcugcggagcgccuccaucgccaacaccaacagcgagaaguacgacuucgaguaccugaacggccucuccuacaccgagcugaccaaccugaucaagaacaucaaguggaaccagaucaacggccucuucaacuacagcacggggucccagaaguucuucggggacaagaaccgcgugcaggcgaucaucaacgcccugcaggagagcggccggaccuacaccgccaacgacaugaaggggaucgagaccuucacggaggugcugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggucaagagccaguuccaccgcguggugggcaacgacaaggcccucgagguggggaacgcggacgacguccugacgaugaagaucuucaacucccccgaggaguacaaguucaacaccaacaucaacggcgugagcaccgacaacgggggccuguacaucgagccccgggggaccuucuacacguacgagcgcacgccccagcaguccaucuucagccucgaggagcuguuccggcacgaguacacccacuaccugcaggcccgcuaccucguggacggccuguggggccaggggccguucuacgagaagaaccggcugaccugguucgacgagggcaccgccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccucaacaccgacgucaagagcuacgacgagaucaucaagaagcuguccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagucccaguacuucaacaccuucacccugcgcggcaccuacacgggcgagaccagcaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4736 - RNA, 3428 nt, Artificial Sequence
  mRNA product Design3 comprising derived and/or modified sequence from Clostridium histolyticum__BAA77453.1__HsALB(1-18)_ColG(111-1118) (opt11)
gggagagucccgcagucggcguccagcggcucugcuuguucgugugugugucguugcaggccuuauucaagcuuaccaugaagugggugacauucaucagccuccucuucuuauucuccagcgccuacuccaucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4737 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt11)
gggagagucccgcagucggcguccagcggcucugcuuguucgugugugugucguugcaggccuuauucaagcuuaccaugaagugggugaccuucaucagccuccucuuccuguucuccagcgccuacuccaugaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4738 - RNA, 3452 nt, Artificial Sequence; identical to SEQ ID NO: 3910
  mRNA product Design3 comprising derived and/or modified sequence from Clostridium histolyticum__BAA34542.1__ColH (opt11)

SEQ ID NO: 4739 - RNA, 3413 nt, Artificial Sequence
  mRNA product Design3 comprising derived and/or modified sequence from Clostridium histolyticum__BAA34542.1__ColH (opt11)
gggagagucccgcagucggcguccagcggcucugcuuguucgugugugugucguugcaggccuuauucaagcuuaccaugaagcgcaagugccugagcaagcggcucaugcuggccaucaccauggccaccaucuucacggugaacuccacccugcccaucuacgcggccgucgacaagaacaacgccaccgccgccgugcagaacgagagcaagcgcuacaccguguccuaccucaagacgcugaacuacuacgaccuggucgaccuccuggugaagaccgagaucgagaaccugccggaccucuuccaguacagcuccgacgcgaaggaguucuacggcaacaagacccggaugagcuucaucauggacgagaucgggcgccgggcgccccaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgccaccggccuccuggccggcaacgagaccgccccgcccgagguggucaacaacuucacgcccauccugcaggacugcaucaagaacaucgaccgguacgcccucgacgaccucaagagcaaggcccuguucaacgugcucgcggccccgaccuacgacaucaccgaguaccugcgcgccaccaaggagaagcccgagaacacgcccugguacgggaagaucgacggcuucaucaacgagcugaagaagcucgcccuguacgggaagaucaacgacaacaacuccuggaucaucgacaacggcaucuaccacaucgcgccccuggggaagcuccacagcaacaacaagaucggcaucgagacccugaccgaggugaugaaggucuacccguaccuguccaugcagcaccuccagagcgccgaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggggccgagcuguucgccgggagcacccgcaccuccggcauccugccgcgcaagagcaucgucuccaacauccacaacacgacccggaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccucuccagcaacuacgcccugaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagucccaguacuucagcacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugcccaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4740 - RNA, 3347 nt, Artificial Sequence
  mRNA product Design3 comprising derived and/or modified sequence from Clostridium histolyticum__BAA34542.1__HsALB(1-18)_ColH(41-1021) (opt11)
gggagagucccgcagucggcguccagcggcucugcuuguucgugugugugucguugcaggccuuauucaagcuuaccaugaagugggugaccuucaucagccugcuguuccuguucuccagcgccuacuccguccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4741 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt11)
gggagagucccgcagucggcguccagcggcucugcuuguucgugugugugucguugcaggccuuauucaagcuuaccaugaagugggugaccuucaucagccucuuauuccuguuuuccagugccuacuccaugaagcgcaagugccugagcaagcggcucaugcuggccaucaccauggcgacgaucuucaccgucaacuccacccugcccaucuacgccgccguggacaagaacaacgccaccgccgcgcgccggcgccggaagcgcgugcagaacgagagcaagcgguacacggucuccuaccucaagacccugaacuacuacgaccugguggaccuccuggugaagaccgagaucgagaaccugccggaccucuuccaguacagcucagacgccaaggaguucuacggcaacaagacccgcaugagcuucaucauggacgagaucgggcggcgcgcgccccaguacacggagaucgaccacaagggcauucccacccuggucgagguggugcgggccggguucuaccugggcuuccacaacaaggagcucaaugagaucaacaagcgcuccuucaaggagcgagucaucccaagcauccuggccauccagaagaacccgaacuucaagcuggggaccgaggugcaggacaagaucguguccgccaccggccuccucgccggcaacgagacggccccgcccgaggucgugaauaacuucacccccauccugcaggacugcaucaagaacaucgaccgcuacgcccucgacgaccucaagagcaaggcgcuguucaacguccuggcagccccgacauacgacaucaccgaguaccuccgggccacuaaggagaagcccgagaacacccccugguacgggaagaucgacggcuucaucaacgagcugaagaaacucgcccuguacgggaagaucaacgacaacaacuccuggaucaucgacaacggcaucuaccacaucgcgccccuggggaagcuccacagcaacaacaagaucggcaucgagaccuugaccgaggucaugaagguguacccguaccuguccaugcagcaccuccaaagcgccgaccagaucaagcgccacuacgacuccaaggacgccgagggcaacaagaucccccuugacaaguucaagaaggaggggaaggagaaauacugccccaagacguacaccuucgacgacggcaaggugaucaucaaggccggggcccgggucgaggaggagaaggugaagcgguuauacugggcgucaaaagaggugaacagccaguucuuccgggucuacggcaucgacaagccccucgaggagggcaacccggacgacauccugaccauggugaucuacaacucccccgaggaguacaagcugaacagcgugcucuacggguacgacacaaacaacggcggaauguacaucgagcccgagggcacguucuucacguacgagcgcgaggcccaggaguccaccuacacccuggaggagcuguuccggcacgaguacacgcacuaccuccaggggagauacgccguccccggccaguggggccgcaccaagcuguacgacaacgaccggcugaccugguacgaggagggaggggccgagcuguucgccgggagcacccgcacguccggcauccugccgcgcaagagcaucguuuccaacauccauaacaccacccggaacaacagauacaagcugagcgacaccguccacuccaaguacggggcgagcuucgaguuuuacaacuacgccuguauguucauggacuacauguacaacaaggauaugggcauacucaacaagcugaacgaccuggccaagaauaacgacguggacggcuacgacaacuacauccgcgaccugucaagcaacuacgcccucaacgacaaguaccaggaccacaugcaggagcggaucgacaacuacgagaaccugacggugcccuucgucgcggacgacuaccuggugcgucacgccuacaagaaccccaacgagaucuacucugagaucagugagguggccaagcucaaggacgccaagucagaggucaagaagucccaguacuucagcaccuucacccugcgggggagcuauaccggcggggccuccaagggcaagcuggaggaccagaaggccaugaacaaguucaucgacgacagccucaagaagcuggacaccuacagcugguccggguacaagacgcugaccgcguacuucaccaacuacaagguggauagcuccaaccgcguaaccuacgacgucguguuccacggcuaccuccccaacgagggcgacagcaagaacucccugccguacgggaagaucaacggcacguacaaggggaccgagaaggagaaaaucaaguucagcuccgagggcuccuucgaccccgacggcaagaucguguccuacgagugggacuucggggacggcaacaagagcaacgaggagaaccccgaacacuccuacgacaaggucgggaccuacaccgugaagcugaaggugacggacgacaagggcgagagcuccgucucuaccaccaccgccgagaucaaggaccucuccgagaacaagcugcccgugaucuacaugcacgugcccaagucaggggcccugaaccaaaaggucguguuuuacggcaagggcacguacgaccccgacggguccauagccggcuaccagugggacuucggggacggcagcgacuucagcuccgagcagaaccccagccacguguacaccaagaagggggaguacaccgucacccucagggugauggacuccagcggccagauguccgagaagacgaugaagaucaagaucaccgauccgguguaccccaucggcaccgagaaggagccgaacaacagcaaggagaccgcguccgggcccaucgucccgggcauccccgugagcgggacgaucgagaacaccuccgaccaggacuacuucuacuucgacgugaucacccccggcgaggucaagaucgauaucaacaagcugggguacggcggcgccaccugggugguguacgacgagaacaacaacgccgucagcuacgcuacggacgacgggcagaaccuguccggcaaguucaaggccgacaagcccgggcgguacuacauccaccucuacauguucaacggcagcuacaugccguaccggaucaacaucgagggguccguaggccgaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4742 - RNA, 923 nt, Artificial Sequence
  mRNA product Design3 comprising derived and/or modified sequence from Homo sapiens__NP_001133.1__HsAMELX (opt11)
gggagagucccgcagucggcguccagcggcucugcuuguucgugugugugucguugcaggccuuauucaagcuuaccaugggcaccuggauacuauucgccugccuccucggcgccgccuucgccaugccccuacccccccaccccggccaccccggcuacaucaacuucucauacgaaguccucaccccccucaaaugguaccaaucaauccgcccccccuaccccuccuacggcuacgaacccaugggaggcuggcuccaccaccaaaucauccccguccucucccaacaacacccccccacccacacccuccaaccccaccaccacauccccgucguccccgcccaacaacccgucaucccccaacaacccaugaugcccguccccggccaacacucaaugacccccauccaacaccaccaacccaaccuccccccccccgcccaacaacccuaccaaccccaacccguccaaccccaaccacaccaaccaaugcaaccccaaccccccguccaccccaugcaaccccuccccccccaacccccccuaccccccauguuccccaugcaaccccucccccccaugcuccccgaccucacccucgaagccuggcccuccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4743 - RNA, 482 nt, Artificial Sequence
  mRNA product Design3 comprising derived and/or modified sequence from Homo sapiens__NP_001133.1__HsAMELX-TRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccauccgcccccccuaccccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4744 - RNA, 515 nt, Artificial Sequence
  mRNA product Design3 comprising derived and/or modified sequence from Homo sapiens__NP_001133.1__HsAMELX-LRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4745 - RNA, 554 nt, Artificial Sequence
  mRNA product Design3 comprising derived and/or modified sequence from Homo sapiens__NP_001133.1__HLA-A2-SP_HsAMELX(17-60) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccauccgcccccccuaccccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4746 - RNA, 587 nt, Artificial Sequence
  mRNA product Design3 comprising derived and/or modified sequence from Homo sapiens__NP_001133.1__HLA-A2-SP_HsAMELX(17-47,168-191) (opt11)
gggagagucccgcagucggcguccagcggcucugcuuguucgugugugugucguugcaggccuuauucaagcuuaccauggccgucauggccccccgcacccucguccuacuccucuccggcgcccucgcccucacccaaaccugggccaugccccuccccccccaccccggccaccccggcuacaucaacuucuccuacgaaguccucaccccccucaaaugguaccaauccauccgccccccccccaugcuccccgaccucacccucgaagccuggcccuccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4747 - RNA, 926 nt, Artificial Sequence
  mRNA product Design3 comprising derived and/or modified sequence from Homo sapiens__NP_001134.1__HsAMELY (opt11)
gggagagucccgcagucggcguccagcggcucugcuuguucgugugugugucguugcaggccuuauucaagcuuaccaugggcaccuggauccucuucgccugccucgucggcgccgccuucgcaaugccccuccccccccaccccggccaccccggcuacaucaacuucuccuacgaaguccucaccccacucaaaugguaccaauccaugauccgcccacccuacucauccuacggcuacgaaccaaugggcggcuggcuccaccaccaaaucauccccgucguaucccaacaacacccccucacccacacccuccaaucccaccaccacauccccgucguccccgcacaacaaccccgcguccgccaacaagcccucaugcccguccccggccaacaauccaugacccccacccaacaccaccaacccaaccucccccuccccgcccaacaacccuuccaaccccaacccguccaaccccaaccccaccaacccaugcaaccccaacccccaguccaacccaugcaaccccuccucccccaacccccccucccccccauguucccacuccgaccccucccccccauccuacccgaccuccaccuugaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4748 - RNA, 485 nt, Artificial Sequence
  mRNA product Design3 comprising derived and/or modified sequence from Homo sapiens__NP_001134.1__HsAMELY-TRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4749 - RNA, 518 nt, Artificial Sequence
  mRNA product Design3 comprising derived and/or modified sequence from Homo sapiens__NP_001134.1__HsAMELY-LRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4750 - RNA, 557 nt, Artificial Sequence
  mRNA product Design3 comprising derived and/or modified sequence from Homo sapiens__NP_001134.1__HLA-A2-SP_HsAMELY(17-61) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgcccccccuacuccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4751 - RNA, 590 nt, Artificial Sequence
  mRNA product Design3 comprising derived and/or modified sequence from Homo sapiens__NP_001134.1__HLA-A2-SP_HsAMELY(17-48,169-192) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaauccaugauccgccccccccccauccuccccgaccuccaccucgaagccuggcccgccaccgacaaaaccaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4752 - RNA, 917 nt, Artificial Sequence
  mRNA product Design3 comprising derived and/or modified sequence from Sus scrofa__NP_999071.1__SsAMELX-001-1 (opt11)
gggagagucccgcagucggcguccagcggcucugcuuguucgugugugugucguugcaggccuuauucaagcuuaccaugggcaccuggauccucuucgccugucuccucggcgccgccuucuccaugccccuccccccccaccccggccaccccggcuacaucaacuucuccuacgaaguccucaccccccucaaaugguaccaaaacaugauccgacaccccuacaccuccuacggcuacgaacccaugggcggcuggcuccaccaccaaaucauccccgucgucucccaacaaaccccccaaucccacgcccuucaaccccaccaccacauccccaugguccccgcccaacaacccggcauaccccaacaacccaugaugccccucccuggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuccucccccaaccaccccuaccccccauguucuccaugcaaucccuccuccccgaccucccccucgaagccuggcccgccaccgacaaaacaaaacgugaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4753 - RNA, 485 nt, Artificial Sequence
  mRNA product Design3 comprising derived and/or modified sequence from Sus scrofa__NP_999071.1__SsAMELX-TRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4754 - RNA, 518 nt, Artificial Sequence
  mRNA product Design3 comprising derived and/or modified sequence from Sus scrofa__NP_999071.1__SsAMELX-LRAP (opt11)
gggagagucccgcagucggcguccagcggcucugcuuguucgugugugugucguugcaggccuuauucaagcuuaccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4755 - RNA, 557 nt, Artificial Sequence
  mRNA product Design3 comprising derived and/or modified sequence from Sus scrofa__NP_999071.1__HLA-A2-SP_SsAMEL(17-61) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccuacaccuccuacggcuacgaacccaugggcggcugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4756 - RNA, 590 nt, Artificial Sequence
  mRNA product Design3 comprising derived and/or modified sequence from Sus scrofa__NP_999071.1__HLA-A2-SP_SsAMEL(17-49,167-189) (opt11)
gggagagucccgcagucggcguccagcggcucugcuuguucgugugugugucguugcaggccuuauucaagcuuaccauggccgucauggccccccgcacccucguccuccuccucuccggcgcccucgcccucacccaaaccugggccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4757 - RNA, 881 nt, Artificial Sequence
  mRNA product Design3 comprising derived and/or modified sequence from Sus scrofa__P45561-2__SsAMELX-001-2 (opt11)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggauacaucaacuucuccuacauccgacaccccuacaccuccuacggcuacgaacccaugggcggcuggcuccaccaccaaaucauccccgucgucucccaacaaaccccccaaucccacgcccuccaaccacaccaccacauccccaugguccccgcccaacaacccggcaucccccaacaacccaugaugccccuccccggccaacacuccaugacccccacccaacaccaccaacccaaccucccccuucccgcccaacaacccuuccaaccccaacccguccaaccccaaccccaccaaccccuacaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4758 - RNA, 917 nt, Artificial Sequence
  mRNA product Design3 comprising derived and/or modified sequence from Sus scrofa__NP_998965.1__SsAMELX-001-3 (opt11)
gggagagucccgcagucggcguccagcggcucugcuuguucgugugugugucguugcaggccuuauucaagcuuaccaugggcaccuggaucuucuucgccugccuccucggcgccucccucgccaugccccucccaccccaccccggccaccccggcuacaucaacuucuccuacgaaguccucacaccccucaaaugguaccaaaacaugauccgccaccccuacaccuccuacggcuacgaacccaugggcggcuggcuccaccaccaaaucauccccgucgucucucaacaaacaccccaaucccacgcccuccaaccccaccaccacauccccaugguccccgcccaacaacccggcauaccccaacaacccaugaugccccuccccggccaacacuccaugacccccacccaacaccaccaacccaaccucccccuccccgcccaacaacccuuccaaccccaacccguccaaccccaaccccaccaaccccuccaaccccaaucccccaugcaccccauccaaccccuacucccccaaccaccccuaccacccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4759 - RNA, 566 nt, Artificial Sequence
  mRNA product Design3 comprising derived and/or modified sequence from Sus scrofa__K7GPB2__SsAMELX-002 (opt11)
gggagagucccgcagucggcguccagcggcucugcuuguucgugugugugucguugcaggccuuauucaagcuuaccaugggcaccuggauccucuucgccugccuccucggcgccgccuucuccaugccccuccccccccaccccggccaccccggcuacaucaacuucuccuacgaaguccucaccccccucaaaugguaccaaaacaugauccgccaccccucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4760 - RNA, 959 nt, Artificial Sequence
  mRNA product Design3 comprising derived and/or modified sequence from Sus scrofa__K7GLD0__SsAMELX-003 (opt11)
gggagagucccgcagucggcguccagcggcucugcuuguucgugugugugucguugcaggccuuauucaagcuuaccaugggcaccuggauccucuucgccugccuccucggagccgccuucuccaugccccuacccccccaccccggccaccccggcuacaucaacuucuccuacgaagaccuuuaccucgaagccauccgcaucgaccgcaccgccuucguccucaccccccuaaaaugguaccaaaacaugauccgccaccccuacaccuccuacggcuacgaacccaugggcggcuggcuccaccaccaaaucauccccgucgucucccaacaaaccccccaaucccacgcccuccaaccccaccaccacauccccaugguccccgcccaacaacccggcaucccccaacaacccaugaugccccuccccggccaacacuccaugacccccacccaacaccaccaacccaaccucccccuccccgcccaacaacccuuccaaccccaacccguacaaccccagccccaccaaccccuucaaccccaaucccccaugcaccccauccaaccccuccucccccaacccccccuaccccccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4761 - RNA, 845 nt, Artificial Sequence
  mRNA product Design3 comprising derived and/or modified sequence from Sus scrofa__K7GPE9__SsAMELX-004 (opt11)
gggagagucccgcagucggcguccagcggcucugcuuguucgugugugugucguugcaggccuuauucaagcuuaccaugggaaccuggauccucuucgccugccuccucggcgcagccuucuccaugccccuccccccccaccccggccaccccggcuacaucaacuucuccuacgaaguccucaccccccuaaaaugguaccaaaacaugauccgccaccccacaccccaaucacacgcccuccaaccccaccaccacauccccaugguccccgcacaacaacccggcaucccccaacaacccaugaugccccuccccggccaacacuccaugacacccacccaacaccaccaacccaaccuaccccuccccgcccaacaacccuuccaaccccaacccguccaaccccaaccccaccaaccccuccaaccccaaucccccaugcaccccauccaaccccuccucccccaacccccccucccacccauguucuccaugcaaucccuccuccccgaccucccacucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4762 - RNA, 869 nt, Artificial Sequence
  mRNA product Design3 comprising derived and/or modified sequence from Sus scrofa__J9JIM4__SsAMELX-201 (opt11)
gggagagucccgcagucggcguccagcggcucugcuuguucgugugugugucguugcaggccuuauucaagcuuaccaugccccuacccccacaccccggccaccccggcuacaucaacuucuccuacgaaguccucaccccacucaaaugguaccaaaacaugauccgccaccccuacaccuccuacggcuacgaacccaugggcggcuggcuccaccaccaaaucauccccgucgucucccaacaaaccccacaaucccacgcccuccaaccccaccaccacauccccaugguccccgcccaacaacccggcaucccccaacaacccaugaugccccuccccggccaacacuccaugacccccacccaacaccaccaacccaaccuaccccuccccgcccaacaacccuuccaaccccaaccaguccaaccccaaccccaccaaccccuccaaccccaaucccccaugcacccaauccaaccccuacucccccaaccuccccuaccacccauguucuccaugcaaucccuccuccccgaccucccccucgaagccuggcccgccaccgacaaaaccaaacgcgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4763 - RNA, 3308 nt, Artificial Sequence
  mRNA product Design3 comprising derived and/or modified sequence from Homo sapiens__NP_006120.1__HsBMP1 (opt11)
gggagagucccgcagucggcguccagcggcucugcuuguucgugugugugucguugcaggccuuauucaagcuuaccaugccaggaguugcccgccuaccacuacuacuaggucuccucuuacucccgcgacccggccgcccacucgaccuagcagacuacacauacgaccucgcagaagaagacgacucagaaccacuaaacuacaaagaucccugcaaagccgcggcauuccucggagacauagcccuggacgaagaagaucuacgagcauuccagguccaacaagcaguagaccuccggcgacacacagcucgcaaaucguccaucaaagcggccgucccaggcaacacaaguaccccuuccugccaguccaccaacggucaaccccaacggggagccugcggacgcuggcguggcaggucacgaucccggcgagcagccaccagcagaccggaacgaguauggcccgacggggucaucccauucguaaucggugggaacuucacgggaucgcaacgagcaguauuccgacaggccaugcgccacugggaaaaacacacaugcgucaccuuccucgaacgcacagacgaagacagcuacauagucuucacauacagaccaugcggaugcugcaguuacgucggacggagaggcggcggcccgcaagcaauaucgauagggaaaaacugcgacaaauucggcauagucguccacgaacuagggcaugucguaggguucuggcacgagcacaccaggcccgaccgagaccgccacguaagcauaguccgcgaaaacauccaacccggacaggaauacaacuuccucaagauggaaccccaagaagucgagucgcugggggaaacauacgacuucgacuccauaaugcacuacgcccgaaacaccuucagccgagguaucuuccucgacacaaucguccccaaguacgaagucaacggcgucaaacccccaauaggccaacggacccgacucucaaaaggugacaucgcucaggcccgcaaacuguauaagugccccgccuguggggagacccuacaggacagcacgggcaacuucagcuccccugaauaccccaacggcuacagcgcacacaugcacugcgucuggcgcaucagugucaccccaggagagaaaaucauccucaacuucaccucacucgaucucuaccgaagcagacucuguugguacgacuacguggagguccgagacggguucuggcgcaaagcaccgcuccgcggccgcuucugcggcucuaaacuucccgaacccauugucagcaccgacucgagacucugggucgaguucaggaguuccagcaacuggguaggcaaaggauucuuugcagucuacgaagccauaugcggcggcgacgucaagaaagacuacggccacauccaguccccaaacuacccagacgacuaccgccccuccaaagucugcauauggaggauacaaguaucagaaggguuucacgucggacugacauuccaaaguuucgaaauagaacgucacgacucaugcgcguacgacuaccuggaaguacgcgacggccauuccgaaagcagcacacuaauaggccgguacuguggcuacgaaaagcccgacgacauaaaaucaacaucaagcagacuguggcuaaaguucgucucggacggaagcauaaacaaagcaggauucgcagugaacuucuuuaaggaagucgacgaauguucgcgcccaaacaggggaggcugcgaacaaagaugccuuaacacacuggggucauauaagugcagcugcgaccccggauacgagcuugcaccagacaagcgaagaugugaggccgccugcggaggcuuccucacaaaacugaacggauccaucacaucacccggauggccaaaagaguaucccccgaauaaaaacugcauauggcagcuaguagcgccaacccaauaccggaucagccuccaguucgacuucuucgaaaccgaaggcaacgacgugugcaaauacgacuucgucgagguacgcagcggucuuaccgcggacucaaaacugcacggcaaauucugcggcagcgaaaaaccagaaguaaucaccagccaauacaacaacaugagagucgaauuuaaaucagacaacaccguauccaagaaaggcuucaaagcccacuucuuuuccgauaaagacgaaugcaguaaagauaacgggggcugucagcaagacugcguuaacacauucggaagcuacgaaugucaaugccgcaguggguucgugcugcacgacaacaaacacgacugcaaagaagcaggaugcgaccauaaagucaccagcacaagcggaacgaucacuagccccaacuggccggacaaauacccauccaagaaagaaugcacaugggccaucuccagcacccccggccaccgcgucaaauuaacauucauggagauggacaucgaaucacaacccgaaugcgccuacgaccaccuggagguauucgacggccgagacgccaaagcaccagugcucggccgcuucugcggcuccaagaaaccagaaccagugcuagccaccggcagucgaauguuccuccgcuucuacagugacaacaguguacaacgaaaaggauuccaagcaagccacgcaacagaaugcgguggccaaguccgggccgacgucaaaacaaaagaccuauacucacaugcucaauucggugacaacaacuacccgggcgguguagacugcgaaugggucaucgucgcagaagagggauacggggucgaacucguguuccaaacauucgaagucgaggaagagacagauuguggcuacgacuacauggaacucuucgacggguacgacagcaccgcccccagacuaggccgcuacuguggaucagguccacccgaagaagucuacagcgccggugacucaguacucgugaaauuccacagcgacgacacaauuacaaagaaaggcuuccaccuaagauacacguccaccaaauuccaggacacccuccacagccgcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4764 - RNA, 1538 nt, Artificial Sequence
  mRNA product Design3 comprising derived and/or modified sequence from Homo sapiens__NP_001191.1__HsBMP2 (opt11)
gggagagucccgcagucggcguccagcggcucugcuuguucgugugugugucguugcaggccuuauucaagcuuaccauggucgccggcacccguugccuccuugcccuccuccuaccccaaguccuacuaggcggagcagccggccucguccccgaacucggccgccgcaaauucgccgccgccucauccggacgccccuccucacaacccagcgacgaaguacucucagaauucgaacuucgucuacucuccauguucggccucaaacaacgacccacucccucccgcgacgcagucguccccccuuacaugcuagaccuuuaccgccgccacuccggccaacccggaucacccgcccccgaccaucgccucgaaagagccgccucccgagccaauaccguccgcucauuccaccacgaagaaucacucgaagaacuacccgaaaccagcggaaaaacaacacgcagauucuucuucaaccucuccagcauccccaccgaagaauucaucaccuccgccgaacuacaaguauucagagaacaaaugcaggacgcccucggcaacaacuccagcuuccaccaccgcaucaacauauacgaaauaaucaaacccgccacagcuaacuccaaguuccccgucacacgccuacucgacacccgccuagucaaccaaaaugccucccgcugggaauccuucgacgucacccccgccgucaugcgauggaccgcacaaggccacgccaaucacggcuucgucguagaaguugcacaccuagaagaaaaacaaggcgucuccaaacgccacguccgcaucuccagaucccuacaccaagacgaacacucauggucccaaauccgcccccuccuagucaccuucggacaugacggcaaaggacacccgcuccacaaacgcgaaaaacgccaagccaaacacaaacaacgcaaacgccucaaaucauccugcaaacgccacccacucuacguagacuucuccgacguaggauggaacgacuggauagucgcacccccaggcuaccacgcauucuacugccacggagaaugcccauucccacuugccgaccaccucaacuccaccaaccacgcuaucguacaaacacucgucaacuccgucaacucaaaaaucccaaaagcaugcugcguccccacagaacucucagccaucuccaugcucuaccucgacgaaaacgaaaaggucguccuaaaaaacuaccaagacauggucgucgaaggcugcggcugccgcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4765 - RNA, 1574 nt, Artificial Sequence
  mRNA product Design3 comprising derived and/or modified sequence from Homo sapiens__NP_001193.2__HsBMP4 (opt11)
gggagagucccgcagucggcguccagcggcucugcuuguucgugugugugucguugcaggccuuauucaagcuuaccaugauaccgggcaaccgcaugcucauggucguucuccugugccaaguccuacucggcggcgcaagccacgccucacucauccccgaaacugggaaaaaaaaagucgccgaaauccaaggccacgccggcggaagacgcuccggccaaucacacgaacuccuccgcgacuucgaagccacccuacuacaaauguucggccuccgccgccgcccacaacccucaaagagcgccgucauccccgacuacaugcgcgaccuauaccgacuccaauccggcgaagaagaagaagaacaaauccacuccaccggacucgaauaccccgaacgccccgccucccgagcaaacaccguacguucuuuccaccacgaagaacaccucgaaaauauccccggcaccuccgaaaacuccgcauuccgcuuccuauucaaccucuccuccauccccgaaaacgaaguaaucucauccgcagaacuccgccuauuccgcgaacaagucgaccaaggccccgacugggaaagaggcuuccaccgaauaaacauuuacgaagucaugaaacccccagccgaagucguacccggccaccucaucacacgacuucucgacacacgccuaguccaccauaacguaacucgcugggaaaccuucgacguaagccccgccguccuccgauggacccgugaaaaacagcccaacuacggccucgcaauugaagucacccaccuccaccaaacacgcacacaccaaggccaacauguccgcauaucccgaucacucccacaaggcuccggcaacugggcccaacuccguccacuccucguuaccuucggccaugacggacgcggucacgcccucaccagacgccgcagggccaaacgaucccccaaacaucacucccagcgcgcucguaaaaaaaacaaaaacugccgccgccauucccuauacguagacuucuccgacgucggcuggaacgacuggauagucgcaccccccggauaccaagccuucuacugccacggcgacugccccuucccacucgcagaccaccuaaacucaaccaaucacgccaucguacaaacccucguaaacucagucaacuccuccauucccaaagccugcugcguacccaccgaacuauccgccaucuccaugcucuaccuagacgaauacgacaaagucguccucaaaaacuaccaagaaauggucgucgaaggcugcggcugccgauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4766 - RNA, 1889 nt, Artificial Sequence
  mRNA product Design3 comprising derived and/or modified sequence from Homo sapiens__NP_001709.1__HsBMP6 (opt11)
gggagagucccgcagucggcguccagcggcucugcuuguucgugugugugucguugcaggccuuauucaagcuuaccaugcccgggcuaggccgacgagcacaauggcuaugcuggugguggggccuacuaugcucaugcugcggaccaccuccccuacgcccaccccugcccgcagccgcugccgcagcugccggcggccaacuacuaggcgacggcggcucacccggccgaacagaacaacccccucccucuccccaauccucauccggauuccuauaccgcagacucaaaacccaagaaaaacgcgaaaugcaaaaagaaauccuaucaguacucggccugccacauagacccagaccccuccacggacuccaacaaccccaaccucccgcccugcgucaacaagaagaacaacaacaacaacagcaacuaccccgcggcgaacccccacccggccgccuaaaaucagcaccccuauuuaugcucgaccuuuacaacgcccucucugccgacaaugaugaagacggcgccuccgaaggugaacgccaacaauccuggccccacgaagccgccucaucaucacaacgacgacaacccccacccggcgccgcccacccacucaaccgaaaaucccuucucgcccccggaucugguuccgggggcgcuuccccacucaccuccgcacaagacagcgccuuccuaaacgacgccgacaugguuaugucauucguaaaccuagucgaauacgacaaagaauuuucacccagacaaagacaccauaaagaguucaaauucaaccucucccaaaucccagaaggcgaagucguaacagccgccgaguuccgaaucuacaaagacugcgucaugggauccuucaaaaaccaaaccuuccuaauaagcaucuaccaaguacuacaagaacaccaacaccgugacuccgaccucuuucuucuagacacccgaguagucugggccucagaagaagguuggcuugaguucgacaucaccgccaccagcaaccuauggguagucacaccccaacacaacaugggacugcaacuaucagucguaacccgcgacggcguacacguucacccccgagcagccggacucguaggucgcgacggacccuacgacaaacaacccuucauggucgccuucuuuaaagucuccgaaguacacguccgaacaacacgauccgcaucaucccgccgccgccagcaaucccggaaccgaucaacacaaucccaagacgucgcccgcgucagcucggcuucggacuacaacuccagcgaacuaaaaacagcaugccgcaaacacgaacuauacgucuccuuucaagaccucggauggcaagacuggaucaucgcacccaaaggauacgcagcaaacuacugcgacggagaaugcuccuucccccuaaaugcacacaugaacgcaaccaaccacgccaucguccaaacccucguccaccuaaugaaccccgaauauguacccaaacccugcugcgccccaaccaaacuaaacgcaaucucaguacucuacuucgacgacaacuccaacguaauccucaagaaauaccgcaacaugguuguccgugccugcggaugccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4767 - RNA, 1643 nt, Artificial Sequence
  mRNA product Design3 comprising derived and/or modified sequence from Homo sapiens__NP_001710.1__HsBMP7 (opt11)
gggagagucccgcagucggcguccagcggcucugcuuguucgugugugugucguugcaggccuuauucaagcuuaccaugcacguccgaucacuacgcgccgcagccccacacuccuucguagcacucugggcaccccuauucuuacuccgcuccgcacuagccgacuucucccucgacaacgaaguccacucgagcuucauccaccgccgccuacggucccaagaaagacgcgaaaugcaacgcgaaauccucucaauucuaggacucccccaccgcccccgcccccaccuccaaggcaaacacaacucugcccccauguucaugcucgaccucuacaacgccauggcaguagaagaaggaggcggacccggcggccaaggcuucucauaccccuacaaagccguuuucucaacccaaggcccgccccucgcaucccuccaagacucacacuuccuaaccgacgccgacaugguaaugucauucgucaaccucguagaacaugacaaagaauucuuccacccccgcuaucaccaccgcgaauuccgauucgaccucucgaaaauacccgaaggcgaagccgugaccgcagccgaauuccgcauauacaaagacuacauccgcgaacgcuucgacaacgaaacauuccgcaucuccgucuaccaagugcuccaagaacaccucggccgcgaaagcgaccucuuccuacuugacucccgcacacuuugggccucugaagaagguuggcucguauucgacauaacagccaccucaaaccacuggguagucaacccccgucacaaccuaggacuccagcuaucaguagaaacacucgacggccagagcaucaaccccaaacuugcgggacucaucggccgccacggaccacaaaacaagcagcccuucauggucgccuucuuuaaagccaccgaaguacauuucagauccauacgcuccaccggguccaaacaacgaucacaaaaccgauccaaaaccccaaaaaaccaagaagcucuacgaauggcaaacguagcugaaaacagcuccucagaccaacgccaagccugcaaaaaacacgaacucuacgucuccuuccgagaccucggcuggcaagacuggaucaucgccccagaaggcuacgcagcauacuacugcgaaggcgaaugcgccuucccccuuaacucuuacaugaacgccaccaaccacgcaaucguccagacccucguacacuucaucaaccccgaaacuguccccaaacccugcugcgcccccacccaauuaaacgcaaucuccguccucuacuucgacgacuccucgaacgucauacucaaaaaauaccgaaacauggucguccgcgccugcggcugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4768 - RNA, 647 nt, Artificial Sequence
  mRNA product Design3 comprising derived and/or modified sequence from Homo sapiens__NP_006264.2__HsCCL7 (opt11)
gggagagucccgcagucggcguccagcggcucugcuuguucgugugugugucguugcaggccuuauucaagcuuaccaugaaagccuccgccgcccuccucugccuccuccucaccgccgccgccuucuccccccaaggccuagcccaacccgucggcaucaacaccuccaccaccugcugcuaccgauucaucaacaaaaaaauccccaaacaacgccucgaauccuaccgccgcaccaccuccucacacugcccccgcgaagccgucaucuucaaaaccaaacucgacaaagaaaucugcgccgaccccacccaaaaauggguccaagacuucaugaaacaccucgacaaaaaaacccaaacccccaaacucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4769 - RNA, 3971 nt, Artificial Sequence
  mRNA product Design3 comprising derived and/or modified sequence from Homo sapiens__NP_001954.2__HsEGF (opt11)
gggagagucccgcagucggcguccagcggcucugcuuguucgugugugugucguugcaggccuuauucaagcuuaccaugcugcucacgcugaucaucuuauuaccggucgucaguaaauuuagcuuuguaucacugagcgcaccccaacacuggucaugcccagagggcacuuuggcagggaacggcaauucgacgugcguaggaccagccccauuccugaucuucagccacggaaauagcaucuuccgaaucgacacagaaggaacgaacuaugagcaacucguagucgacgcagggguaucgguuaucauggacuuccauuacaacgagaaaagaauauacugggucgaccuagaacgacagcuccugcaaaggguauuccugaacggcucgcggcaggaacggguaugcaacauagagaaaaacgucagcggcauggccauaaacuggaucaacgaagaagugaucugguccaaccaacaggaaggcaucauaaccgucacugacaugaaaggaaacaacagccacauccuccuaucagcgcuaaaguaccccgccaaugucgcggucgacccaguagaacgguucauuuucugguccuccgaaguagcugggagccuuuaccgcgcagaccuagacggcgucggaguaaaagcacuacuugaaacauccgagaaaauaacagcaguaucccuugacguccuagacaagcgccucuucuggauacaauacaaucgcgaagggucuaacagccucaucugcaguugugacuaugacggcgggagcguacacaucucaaaacacccaacacaacauaaucuauucgcgaugagccucuucggugacagaauauucuacucaaccuggaagaugaaaacaauauggauagccaacaaacacacaggcaaagacaugguccgcaucaaccuccacagcuccuucguaccccucggcgaacuaaaaguagugcacccccuagcccagcccaaagccgaagaugauacgugggaacccgaacaaaagcugugcaaacugcgcaaagggaacugcagcaguaccguuugcggucaagacuuacagucucaccucugcaugugcgcugagggguacgcccuuucgagagacagaaaauacugcgaggacgucaacgaaugcgccuuuuggaaccacggcugcacacuuggcugcaaaaauacaccgggaagcuacuacugcacaugucccguaggauucguccuucuacccgauggaaagcgcugccaccaacuggucucguguccucgcaacgucucggaaugcagccaugacugcguacuaaccuccgaagguccacuaugcuucugcccagaggguucaguucuagagcgggacggcaagacaugcaguggaugcucauccccagacaacggcggaugcucccaacuaugcgucccacugagcccggucucaugggaaugcgacugcuucccuggguacgaccuccagcuugaugaaaaaucaugcgcugccuccgggccccagcccuuccuacucuucgccaacucgcaagacauaagacauaugcacuucgacggcacagauuacgggacccugcugucccaacagaugggcaugguauacgcacucgaccacgacccaguggaaaauaaaaucuauuucgcccacacagcccuuaaguggaucgaacgcgccaacauggacggcagccaaagagaacggcucauagaagaggggguggacgugccagagggccucgcugucgacuggauagggcgccgguucuacuggacagaccggggcaaaagccucauaggcagaucagaccucaacgggaaaaggagcaagaucauaacgaaagagaauaucucgcaaccccgcggaaucgccguccacccaauggcaaaaagacuauucuggacagauacgggaauaaacccccggaucgagagcuccucccuacaagggcucgggcgguuaguaaucgccuccagcgaccuaauauggcccagcgggauuaccaucgacuuccuaacagacaaacucuacuggugcgacgcaaaacaauccgucaucgaaauggccaaucuagacgguagcaaacgacgccgacucacacaaaacgacguaggccaucccuuugcggucgccgucuucgaggacuacgucugguucucugauugggccaugcccucagucaugcgagucaacaagcgcacgggaaaggaucgagugaggcuccagggcucgauguugaaaccaagcagccuaguagucguccacccacuggcaaaaccaggcgcagacccaugccuauaccagaacgggggcugugagcacaucuguaaaaagagacuaggaaccgcauggugcucaugcagggaaggguucaugaaagcguccgacggcaaaaccugccuugccuuagacggacaccaacuccuagcaggaggcgaaguugaccuuaaaaaccaaguaacgccguuagauauccucagcaaaacaaggguaagcgaggauaacaucaccgagucacagcacaugcucguggcagaaauuauggugucagaccaagacgacugcgcacccguaggcugcucuauguacgcaagaugcauauccgaaggcgaagacgccacaugccagugccugaagggcuuugccggggacgguaaacugugcuccgacauagaugagugcgaaaugggaguacccgucuguccgcccgcaagcuccaaaugcauaaacacagaaggcggauacgugugccggugcucagaaggauaccaaggcgacggaauccacugccuggacaucgacgaaugccaguuaggugaacauucgugcggggaaaacgccuccugcacuaacaccgaaggaggcuacacaugcaugugcgccggacgucugagcgaacccgggcuaauaugccccgacuccacaccacccccacacuugcgcgaggacgaccaccauuacagcguacggaacagcgacagcgaaugcccccuaucacacgacggcuacugcuuacacgacggcgucugcauguacaucgaagcccuagacaaauacgcgugcaacugcgugguagguuacauaggugagcguugccaauaccgagaccuuaaauggugggaacuacgccacgccggacacggccaacagcagaaggucaucgucgucgcaguaugcgucguaguccucgucaugcuucuacuccuaucacuauggggcgcacacuacuacagaacucaaaaauuauuaagcaagaaccccaaaaauccguacgaggaauccagcagagauguccgcagccggagaccggcggacacggaggacggcauguccucgugcccgcaacccugguucgucgucaucaaagaacaccaagaccugaagaacggcggccaacccguagcaggagaagacggacaagccgccgacggaagcaugcaaccgaccucguggcgacaagaaccccagcuaugcggcaugggcacugagcagggcugcuggauuccaguaaguagugacaaagguagcugcccacaggucauggagcgauccuuccauaugccuucuuacggaacacaaacacuagaaggcgguguagaaaagccgcauucucuccuguccgcaaacccgcucuggcaacaacgagcacuagauccaccccaccaaauggaacucacccaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4770 - RNA, 857 nt, Artificial Sequence
  mRNA product Design3 comprising derived and/or modified sequence from Homo sapiens__NP_001423.1__HsEREG (opt11)
gggagagucccgcagucggcguccagcggcucugcuuguucgugugugugucguugcaggccuuauucaagcuuaccaugaccgccggccgccgcauggaaaugcucugcgccggccgcguccccgcacuccuccucugccucggcuuccaccuccuucaagccguccucuccaccaccgucauccccuccugcauccccggcgaauccuccgacaacugcaccgcccuaguccaaaccgaagacaacccacgcgucgcccaagucuccaucacaaaaugcuccuccgacaugaacggcuacugccuccacggccaaugcaucuaccucgucgacaugucccaaaacuacugccgcugcgaagucggcuacaccggcguccgcugcgaacacuucuuccucaccguccaccaaccccucuccaaagaauacgucgcccucaccgucauccucaucauccucuuccucaucaccgucgucggcuccaccuacuacuucugccgcugguacagaaaccgcaaauccaaagaacccaaaaaagaauacgaacgcgucaccuccggcgaccccgaacucccccaagucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4771 - RNA, 815 nt, Artificial Sequence
  mRNA product Design3 comprising derived and/or modified sequence from Homo sapiens__NP_000791.1__HsFGF1 (opt11)
gggagagucccgcagucggcguccagcggcucugcuuguucgugugugugucguugcaggccuuauucaagcuuaccauggccgaaggcgaaaucaccaccuucaccgcccucaccgaaaaauucaaccucccccccggcaacuacaaaaaacccaaacuccucuacugcuccaacggcggccacuuccuccgcauccuccccgacggcaccgucgacggcacccgcgaccgcucagaccaacacauccaacuccaacucuccgccgaauccgucggcgaaguauacauaaaauccaccgaaaccggccaauaccucgccauggacaccgacggccuccucuacggcucccaaacccccaacgaagaaugccucuuccucgaacgccucgaagaaaaccacuacaacaccuacaucuccaaaaaacacgccgaaaaaaacugguucguaggccucaaaaaaaacggcuccugcaaaagaggcccccgcacccacuacggccaaaaagccauccucuuccucccacuccccgucucaucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4772 - RNA, 1214 nt, Artificial Sequence
  mRNA product Design3 comprising derived and/or modified sequence from Homo sapiens__NP_001997.5__HsFGF2 (opt11)
gggagagucccgcagucggcguccagcggcucugcuuguucgugugugugucguugcaggccuuauucaagcuuaccaugguggggguagggggaggggacguggaggacguaacgccgaggccgggagggugucagauaagcgggagaggggcgagagggugcaacggaauaccgggagcggcggcgugggaggcggcgcugccgaggaggaggccgaggaggcacccgagcguaaacccaagaagcagagcagcagggagcccgaggacgagggggagaaggacggaggagaggccgagugggagcaggcugggggaucgggggagggggagagcacugccgggagggcgacuagggggaagagggagggggagggcgccggagagggugggagggagggggagggggagggggacggcggcgccgagagcggcgccggcggcgagggggagcaggccgggaccggcggggacgauggcagcggggagcauaaccacguugccggcgcugccggaagauggagggaguggggcguucccaccggggcacuucaaggauccgaagagacuguauuguaagaauggaggguucuuucuaaggauacauccggaugggagaguggauggggugagggaaaagagugacccgcacauaaagcugcaguugcaggcggaggagagagggguaguaagcauaaagggggugugcgcaaauagguaucuggcgaugaaggaggaugggaggcuauuggcgagcaagugugugacggacgagugcuuuuucuuugaaaggcuagagagcaauaacuacaacacguacaggagcagaaaguauacgagcugguauguggcgcugaagagaacgggacaguacaaguuagggagcaagacagggccagggcagaaggcaauauuguuccugccaaugagugcaaagagcuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4773 - RNA, 932 nt, Artificial Sequence
  mRNA product Design3 comprising derived and/or modified sequence from Homo sapiens__NP_002000.1__HsFGF7 (opt11)
gggagagucccgcagucggcguccagcggcucugcuuguucgugugugugucguugcaggccuuauucaagcuuaccaugcacaaauggauccucaccuggauccuccccacccuccucuaccgcuccugcuuccacaucaucugccucgucggcaccaucucccucgccugcaacgacaugacccccgaacaaauggccacaaacgucaacugcuccucccccgaacgccacacccgcuccuacgacuacauggaaggcggcgacauccgcguccgccgacucuucugccgcacccaaugguaccuacgcaucgacaaacgcggcaaaguaaaaggcacccaagaaaugaaaaacaacuacaacaucauggaaauccgcacagucgccgucggcauagucgcaaucaaaggcgucgaauccgaauucuaccucgccaugaacaaagaaggcaaacucuacgccaaaaaagaaugcaacgaagacugcaacuucaaagaacucauccucgaaaaccacuacaacaccuacgccuccgccaaauggacccacaacggcggcgaaauguucgucgcccucaaccaaaaaggcauccccguccgcggcaaaaaaaccaaaaaagaacaaaaaaccgcccacuuccuccccauggccaucaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4774 - RNA, 974 nt, Artificial Sequence
  mRNA product Design3 comprising derived and/or modified sequence from Homo sapiens__NP_001936.1__HsHBEGF (opt11)
gggagagucccgcagucggcguccagcggcucugcuuguucgugugugugucguugcaggccuuauucaagcuuaccaugaaacuccuccccuccguaguccucaaacuauuccucgcagccguccuauccgcccucgucaccggcgaaucacucgaacgccuccgccgcggccucgccgcaggcacaagcaaccccgacccccccaccgucuccaccgaccaacuccucccccuaggcggcggccgagaccgcaaaguccgcgaccuccaagaagcagaccucgaccuccuccgcgucacccucuccuccaaaccccaagcccuagcaacccccaacaaagaagaacacggcaaacgaaaaaaaaaaggcaaaggacuaggcaaaaaacgcgaccccugccuccgcaaauacaaagacuucugcauccacggcgaaugcaaauacgucaaagaacuacgcgcccccuccugcauaugccaccccggcuaccacggcgaacgaugccacggccuaucccuccccguagaaaaccgacuauacaccuacgaccacaccaccauccucgccgucgucgccgucguccucucauccgucugccuacucguaaucguaggacuccucauguuccgcuaccaccgccgaggcggcuacgacgucgaaaacgaagaaaaagucaaacucggcaugaccaacucccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4775 - RNA, 2534 nt, Artificial Sequence
  mRNA product Design3 comprising derived and/or modified sequence from Homo sapiens__NP_000592.3__HsHGF (opt11)
gggagagucccgcagucggcguccagcggcucugcuuguucgugugugugucguugcaggccuuauucaagcuuaccaugugggucacuaaacuacuccccgcccuccuacugcaacacguucuccuccaccuauuacugcuccccauugcaaucccauacgccgaaggccagcgaaaacgccgcaacacgauccacgaauuuaagaaaagcgcaaaaacaacccuaaucaaaauagacccugcacuaaaaauaaaaaccaagaaagucaacacagcagaccaaugcgcuaacagaugcacccggaacaaaggccugccguucacaugcaaggcauucgucuucgacaaggcccgcaaacaaugccugugguucccauucaacucaaugagcucaggcgucaagaaagaguucggacacgaguucgaccucuacgaaaacaaagacuacauccgcaacuguaucaucggaaaaggaagauccuacaaaggcacaguaucaaucaccaaguccggcaucaaaugccaacccuggagcagcaugaucccccacgaacacuccuuccuccccagcucguaccgcggcaaagaccuccaagaaaacuacugccggaacccccgaggagaagaaggcggucccuggugcuucaccuccaaccccgaaguccgcuacgaagucugcgacaucccccaaugcagcgaaguagaaugcaugaccugcaacggcgaauccuacagaggccuaauggaucacaccgaauccggcaagauaugccaacgcugggaccaucaaaccccacaccgccacaaguuccuacccgaacgcuaccccgacaaaggauucgacgacaacuacugccgcaacccugacgggcaaccacgccccuggugcuacacccuagacccacacacacgaugggaauacugcgccaucaaaaccugcgccgauaacacaaugaacgacacugacgucccacuagaaaccaccgaaugcauacaaggacaaggcgaagguuacagaggaaccguaaacacuauauggaacggcauaccuugccaacgcugggacucccaauacccacacgaacacgacaugacucccgaaaacuucaaaugcaaagaccuccgcgaaaacuacugccgcaaucccgauggguccgaaagucccuggugcuucaccacagacccaaacauccgcgugggauacugcucccaaauucccaacugcgacaugucucacggucaagacugcuaccgaggcaacggcaagaacuacaugggaaaccugucacagaccagauccggucuaaccugcuccaugugggacaaaaacauggaagaccuccacaggcacauauucugggaacccgacgccuccaagcucaaugaaaacuacugcaggaaccccgacgacgacgcccacggccccugguguuacacaggaaacccccucauuccuugggacuacugcccaauaucacgcugcgaaggugacacuacacccacaauagucaaccucgaccaccccgucaucucuugcgccaaaacaaaacaacucaggguagucaacggaauccccaccaggacaaacauaggcuggauggucucccuacgguaccgcaacaaacacaucugcggaggcucacugaucaaagaauccuggguccucaccgcacgccaaugcuuccccagcagagaccucaaagacuacgaagccugguuagguauucacgacguccacggcagaggggacgaaaaaugcaagcaaguccucaacguaagccagcucgucuacggacccgaaggaucggaccucguacucaugaaacuggcccgccccgcaguacucgacgacuucgucucaacgauugaccugccaaacuacggaugcacgaucccagaaaagacgucauguagcgucuacgguuggggcuacacgggccucaucaacuacgacggccuccuccgagucgcacaccuuuauaucaugggcaacgaaaaaugcagccagcaccaccgaggcaaagucacacuuaacgaauccgaaaucugugcaggagccgagaaaauaggcucaggacccugcgaaggcgacuacggcggaccccuggucugcgaacaacacaaaaugcgcaugguccuuggcgucaucguacccggacgaggcugcgccauccccaaccgccccggcauauucgucagaguugcauacuaugcaaaauggauccauaaaaucauacuaacauacaaagucccccagucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4776 - RNA, 2273 nt, Artificial Sequence
  mRNA product Design3 comprising derived and/or modified sequence from Homo sapiens__NP_005336.3 __HsHSPA1A (opt11)
gggagagucccgcagucggcguccagcggcucugcuuguucgugugugugucguugcaggccuuauucaagcuuaccauggcaaaagcagcagcaauaggcaucgaccuaggaaccaccuacucaugcgucggagucuuccagcacggcaaaguagaaauaaucgcuaacgaccaaggaaacagaaccacgcccucguacgucgccuucaccgacaccgaacgacugauaggggacgcagcaaagaaccaggucgcacucaacccacaaaauacagucuucgacgcaaaaagacucauaggcagaaaauucggcgaccccguagugcaaagcgacaugaaacacuggccauuccaagugauaaacgacggggacaaaccaaaaguccaagucucauacaaaggcgaaacaaaggcauucuacccagaagaaaucuccagcauggucuuaaccaaaaugaaagaaauagccgaagcauaccucgguuacccaguaacgaacgcagucauuacaguacccgcauacuucaacgacagccaacggcaagccacgaaagacgcgggagucauagcagggcucaacguauuaagaauaaucaacgaaccaacagcagcagccaucgcauacggccuggaucgcacaggcaagggcgaaagaaacguacugaucuuugaccuaggcgggggcacguucgacguaagcauccugaccauagacgacgggauuuucgaggucaaagcaacagcaggggacacacaccugggcggggaagacuucgacaacagacucgugaaccacuucguagaagaguucaaacgcaaacacaagaaagacaucucgcagaacaaaagagcagugagaagacuacggaccgcgugcgagcgcgcaaaacgcacccuaagcucaagcacgcaggcgagccuggaaauagacagccucuucgaaggaaucgacuucuacacaucuauaacaagagcgagauucgaagaacugugcuccgaccucuuccgcuccacgcuggagccagucgaaaaagcgcuccgggaugcgaaacuggacaaagcacaaauccaugaccucguacuggucggaggcucgacccgcauuccaaaagugcaaaaacuccuccaggacuucuucaacggacgagaccucaacaaaucaaucaaccccgacgaagcagucgcguacggggccgcuguccaagccgcaauccugaugggggacaaaagcgagaaugugcaagaccuccuccuccucgacguggccccacucucgcuuggacucgagaccgcgggaggcguaaugacagcacucauaaaaagaaauucaacaaucccaacaaagcagacacagaucuucacaacguauagcgacaaucaaccgggcguacucauacaaguauacgagggcgaacgcgcaaugacgaaggacaacaaccuucuaggcagauucgagcucucaggcauaccaccagccccacgcgggguaccgcaaauagaagugacauucgacaucgacgcaaacggaaucuuaaacguaacagcgaccgauaaaucaaccggaaaggcgaacaaaaucacaaucacaaacgacaaaggacgccuuucaaaagaagagaucgagagaaugguacaggaggcagaaaaguacaaagcagaggacgagguccaacgcgaaagaguauccgccaaaaacgcccuggaaucauacgcauucaacaugaaguccgccgucgaagacgaaggucuaaagggaaagauauccgaagccgacaaaaagaaaguacuagauaaaugccaagaagucaucagcuggcucgacgcaaacaccuuggccgaaaaagacgaauuugaacacaaaagaaaagaacuugaacaaguaugcaaucccauaaucucaggccuguaccaaggcgcaggcgggccagggcccgggggcuuuggggcacaaggccccaaaggaggaagcggaagcgggccgacaauagaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4777 - RNA, 2273 nt, Artificial Sequence
  mRNA product Design3 comprising derived and/or modified sequence from Homo sapiens__NP_005337.2 __HsHSPA1B (opt11)
gggagagucccgcagucggcguccagcggcucugcuuguucgugugugugucguugcaggccuuauucaagcuuaccauggcgaaagcagcagcaaucggaaucgaccucgguaccacauacagcugcguaggcguauuccaacacgggaaaguagaaaucauagcaaacgaccaagggaaccggacaacccccuccuacgucgccuucaccgacacagaacgacuuaucggcgacgcagccaaaaaccaggucgccuuaaacccccaaaacaccgucuucgacgcaaaaagacucaucggaagaaaauucggggaccccgugguacaaagcgacaugaaacacuggcccuuccaaguaaucaacgacggagauaagcccaagguccaaguaucguacaaaggcgagaccaaagccuucuacccagaagaaauaucaagcaugguguuaaccaagaugaaggaaaucgccgaagccuaccucggcuacccagugacaaacgccguaauaaccgugcccgcguacuucaaugacucccaacgccaagccacgaaagacgccggcgucauagccggacuaaacguacuacgcauaauaaaugaaccgacagcagccgccaucgcauacggacucgaccgcacaggcaaaggcgaaagaaacguauugauauucgacuuaggcggaggcaccuucgacgucucgauacuaaccauagacgacggaauauucgaggucaaggccaccgccggagacacacaccuaggcggcgaagacuucgauaaucgucuagugaaccacuucguagaagaguucaagcgcaaacacaagaaagacaucucccaaaacaaacgugcagugcgaaggcuaagaaccgcaugcgaacgcgcaaaaagaacccucagcuccagcacacaagcgagccuagaaauagacagucucuucgaaggcaucgauuucuacaccucgauaacuagagcgcgcuucgaagaauuaugcagcgacuuauuccgaucgacauuagaaccuguagaaaaagcgcuccgggacgcgaaacuagacaaagcccaaauccacgacuugguccugguagggggcucuacaaggauaccgaaagugcaaaagcuauuacaagacuucuucaacggacgcgaucucaauaaauccaucaaccccgacgaggcaguagcauacggcgccgcgguccaggcagcgauacucaugggagacaaaucagaaaacgugcaagaccuccugcuccuugacguagcaccacucucgcucggacuagaaacggcgggaggggucaugaccgcacucaucaagagaaacaguaccaucccaaccaaacaaacccaaaucuucaccacauacucagacaaccaaccgggagugcuaauccaaguauacgaaggcgaacgcgcgaugaccaaagacaauaaccugcuaggaagauucgaacuaucaggcauacccccggcuccacgaggcgucccccaaaucgaaguaaccuucgacauagacgccaacggaauccucaacgugacagcgaccgacaaaagcaccgggaaagcaaacaaaaucacaaucacaaacgacaaaggacgauuaagcaaagaagagaucgagcgaaugguccaagaagccgaaaaguacaaagccgaagacgagguccaacgcgaacgaguaagcgccaaaaacgcauuagaauccuacgcguucaauaugaaaagcgcaguagaagacgaaggacugaaagggaaaauaagcgaagcagacaaaaagaaaguacucgacaaaugccaagaaguaaucuccuggcuagacgcaaauacccucgccgaaaaagacgaguucgaacacaaaagaaaagaacuggaacaagugugcaacccaauuaucucaggacuauaccagggggcaggcgggccaggacccggaggauucggcgcgcaaggaccaaaaggaggcagcggaagcggaccaacaaucgaggaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4778 - RNA, 2273 nt, Artificial Sequence
  mRNA product Design3 comprising derived and/or modified sequence from Homo sapiens__NP_005518.3 __HsHSPA1L (opt11)
gggagagucccgcagucggcguccagcggcucugcuuguucgugugugugucguugcaggccuuauucaagcuuaccauggcgacagcaaagggcauagcaauaggcaucgaccucggcaccacauacuccugcguaggcgucuuccaacacggcaaaguagaaaucaucgcaaacgaccaaggaaacaggacaacacccucauacgucgcauuuaccgacaccgaaagacuuaucggagacgcggccaaaaaccaggucgcaaugaacccccaaaauaccgucuucgacgcaaagcgacucauaggacgcaaauucaaugaccccgugguacaggcagacaugaaacuauggccguuccaaguuauaaacgaaggcggaaagccgaaaguccucguauccuacaaaggcgaaaacaaagccuucuaccccgaggaaaucucgagcaugguccuaaccaaacucaaagaaacagccgaagcauuccucgggcacccagucaccaacgcggucauaaccguaccagcauacuucaacgacucgcaaagacaggcaaccaaagacgccggagucaucgcaggacugaacguccuccgaaucaucaacgaaccaaccgccgcagccaucgccuacggacuagacaaaggcgggcaaggcgaacggcacguacuuaucuucgaccucgggggcggaaccuucgacgucuccauccugaccaucgacgaugggauauucgaagucaaagccacggccggagacacacaccucggaggcgaagacuucgacaaccgccuaguaagucacuucgucgaagaguucaaacgaaaacacaaaaaggacaucagccagaacaaacgagcaguacgccgccucaggacagcaugcgaacgcgccaaaaggacacuaagcuccuccacgcaagcaaaccucgaaauagacagccuauacgaaggaauagacuucuacacaagcaucacaagggccagauucgaagaacucugcgcagaccuauuccggggcacacucgaaccagucgaaaaagcgcugcgagacgccaagauggacaaagccaaaauccaugacauaguccucgucggaggcuccacccgaauccccaaaguacaacgacuucuacaggauuacuucaacggaagagaucucaauaaaucaaucaaccccgacgaggcggucgcauacggcgccgccgugcaggccgcaauacucaugggggacaaaagcgagaaaguacaagaccuguuacuacuggauguggcaccccuaagccucgggcuggaaaccgccggaggggucaugaccgcccucaucaaacgaaacuccacgauccccacaaaacaaacccaaauauucaccaccuacuccgacaaccagccaggaguacuaauccaaguauacgaaggagaacgcgccaugacaaaagacaacaaccuacuaggccgguucgaucuaacaggcauaccaccggcgccccgagggguaccccaaaucgaaguaacauucgacaucgacgccaacggcauacugaacgugaccgcaacggacaaaucgaccgggaaagugaacaaaauaacaaucacaaacgacaagggccgcuuaagcaaggaagaaaucgagcgcaugguccuagacgcagaaaaauacaaagccgaagacgaaguacaacgagagaaaaucgccgcgaagaacgcgcuggaaagcuacgcauucaacaugaaaagcguaguaucagacgagggacuaaaaggcaaaauaagcgaaagcgacaaaaacaaaauacucgacaaaugcaacgaacuacuaagcuggcuagaagucaaucaacucgccgaaaaagaugaguucgaccacaaacgcaaggaacucgaacaaaugugcaacccaauaaucaccaaacuuuaccaaggaggcugcacaggcccagcaugcggaacaggcuacguaccaggccgaccugccaccggccccaccauagaagaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4779 - RNA, 2267 nt, Artificial Sequence
  mRNA product Design3 comprising derived and/or modified sequence from Homo sapiens__NP_068814.2 __HsHSPA2 (opt11)
gggagagucccgcagucggcguccagcggcucugcuuguucgugugugugucguugcaggccuuauucaagcuuaccaugagugcgcgcggacccgcaaucggaauagaccucggcaccaccuacucaugcgugggcguauuccagcacggaaaagucgaaauaaucgcaaacgaccaagggaacagaaccacaccauccuauguggccuuuacugacaccgaacgccuaaucggagacgcugccaagaaccagguagcaaugaaccccacaaacacaaucuucgacgcaaagaggcuaaucggacgcaaguucgaagacgcaacaguccaaagcgacaugaagcacuggcccuuccgcguaguauccgaaggaggcaaacccaagguccaagucgaauacaaaggcgagacaaagaccuuuuucccagaagagaucucaagcaugguacucaccaaaaugaaagaaauagcggaggcauaucuuggaggaaagguccacagcgcagugauaacaguccccgcauacuuuaacgacagccaaagacaagcaacaaaagacgcaggaaccauaacaggacuuaacguccuccgaauaaucaaugaaccaacagcagcagcaaucgcauacggccuagacaagaaaggcugcgccggaggcgagaaaaacguccuaauauucgaccuaggcgggggaacguucgacgucucaauacucaccauagaagacggcaucuucgaggucaaaagcacggccggagacacacaccucggcggggaagacuucgacaaccgcauggugagccaucucgccgaagaguucaaaagaaagcacaagaaagauauaggccccaacaaacgggcagugagaaggcucaggaccgcaugcgaacgggcgaaaagaacccucagcucaagcacacaagcaaguauugaaaucgacucccuauacgaagggguagacuucuacaccucaaucacacgggcccgcuuugaggaacuaaacgccgaucuguuccgcggaacacuagaaccagucgaaaaagcacuccgagacgcaaaauuagacaaaggccaaauucaagaaauaguccuggucggagguuccacccgcaucccaaaaauccaaaaacuacuacaagacuucuucaacgggaaagaacucaacaaaucaauuaaccccgaugaagcagucgccuacggagcagcaguacaagcagcgauacucaucggggacaaaagcgagaacguccaagaccuacuacugcuagacgugaccccacucucacucgggauagagacagcaggcggaguaaugaccccacugauaaaacgaaacacaaccauacccacaaaacagacccagaccuucacaaccuacagcgacaaccagucauccguacucguccagguguacgagggagaacgagcaaugacgaaagacaacaaccuauugggcaaguucgaccuaacgggcauaccgcccgcgccccgcgguguaccacaaaucgaagucacuuuugacauagacgccaacggaauccuaaacgugaccgcggccgacaaaagcacagggaaggaaaacaagaucacaauaacaaacgacaaagggagacugagcaaagacgacauugaccgaaugguccaagaagcagaacgcuacaaaucugaagaugaggcaaacagagaccgagucgcugcaaagaacgcacuggaaucuuacaccuacaacaucaagcagaccgucgaagacgaaaaacugcgaggaaaaauaagcgaacaagacaaaaacaaaauacuggacaaaugucaagaagucauaaacuggcucgaccgaaaccaaauggccgaaaaagacgaauacgaacacaaacaaaaagaacucgaacgaguaugcaaccccauaaucucaaaauuauaccaaggaggcccaggaggcgggagcggcggaggaggcuccggagcgagcggaggccccaccaucgaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4780 - RNA, 2870 nt, Artificial Sequence
  mRNA product Design3 comprising derived and/or modified sequence from Homo sapiens__NP_002145.3 __HsHSPA4 (opt11)
gggagagucccgcagucggcguccagcggcucugcuuguucgugugugugucguugcaggccuuauucaagcuuaccaugucggucguaggaaucgaucugggcuuucaaucaugcuacguugcaguggcgagagcaggaggaaucgaaaccauagccaacgaauacagcgauagguguacgccggcaugcaucagcuucggccccaaaaacagaucaauaggagcagccgccaaaucacaagucaucuccaacgcaaagaacaccguacaaggcuucaagcgauuccauggcagagccuuuucggacccguucgucgaagcugaaaaauccaacuuagcguacgacauaguucaacucccaacaggauuaaccggcaucaaagucaccuacauggaagaggagcgaaacuuuaccaccgaacagguaaccgcgaugcuccuaagcaagcuaaaggaaaccgcagaaagcguccucaaaaagcccgucguagauugcguggucuccgucccaugcuucuacacggacgcagaacgucgcagcguaauggacgccacacaaauagccggacucaacugccuacggcugaugaacgaaacgaccgcagucgcacuggccuacgggauauauaagcaagaccuaccagcgcuggaagaaaaaccacguaacguggucuucgucgacaugggacacuccgccuaccaagucuccgugugcgcguucaaccgcggcaaacucaaaguccucgcaacagcguucgauaccacauugggcggacgcaaguucgaugaaguacucguaaaccacuucugcgaggaguucggcaaaaaguacaaacucgacaucaaaucgaaaauacgagcacuacuccgccuuagccaagaaugugaaaaacuaaagaaacugaugucagcaaacgccagcgaccuaccacuaucaauagaaugcuucaugaacgacguagacguaagcggaacgaugaaucgcggaaaauuccuggaaaugugcaacgaccuccucgcccgaguugagccgccacuacggagcgugcucgaacaaaccaagcucaagaaagaagacauauacgccguagaaauagucgggggcgcaacccgcauccccgccgugaaagagaaaaucucaaaauucuucgggaaagaacucagcaccacacucaacgccgacgaagcggugacccgaggcugcgcgcuccaaugcgcaauccuaagccccgccuucaaaguacgagaguucuccauaaccgacguaguccccuaucccauaucccuuagguggaauagccccgcagaagaaggcagcagcgacugcgaaguauucagcaaaaaccacgccgcacccuucucaaaaguacugaccuucuaccgaaaagaaccauucacacucgaggcauacuacagcuccccacaggaccucccauacccagacccggccaucgcccaauucagcguacaaaaagucacaccacaaagcgacgguagcucgagcaaagucaagguaaaaguccgggucaacguucacggcauauucucaguaagcagcgcaagccucguagaaguacacaaauccgaggaaaacgaagaacccauggaaaccgaccaaaacgccaaagaagaagagaaaaugcaaguagaucaagaggaaccacacgucgaggaacaacagcaacagacccccgccgaaaacaaagcagaaagcgaagaaauggaaaccagccaagccggcuccaaagauaagaaaauggaccaaccaccacaagccaaaaaggccaaagucaaaacauccacagucgaucuccccauagaaaaccaacuacuauggcaaaucgaccgcgagaugcucaacuuauacauagagaaugaaggcaaaaugauaaugcaagacaaacucgaaaaagagagaaacgacgccaaaaacgcagucgaagaauacgucuacgaaaugcgagacaaacuaagcggcgaauacgagaaauucguaucggaagacgacagaaacagcuucacccuaaagcuggaggacaccgaaaacuggcuauacgaagacggagaagaccaacccaaacaaguauacguagacaaacucgcagaacucaaaaaccuaggccaacccaucaaaauacgauuccaagaauccgaggaacgccccaaauuauucgaagaacucggcaagcaaauccaacaguacaugaaaauaauaucgagcuucaaaaacaaagaagaccaauacgaucaccuggacgcagcagacaugacuaaaguagaaaaaucaacaaacgaagcaauggaauggaugaacaacaaacucaaccuucaaaacaagcaaagccuuaccauggacccaguagucaaaagcaaggaaaucgaagccaagaucaaagagcucacaucaaccuguuccccuaucauaucaaaacccaaaccaaaaguagaaccacccaaggaagaacagaaaaacgccgaacaaaacggccccgucgacggacaaggcgacaaccccggcccccaagccgccgaacaagggaccgacaccgcaguaccaagcgacagcgauaagaaacuucccgaaauggacaucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4781 - RNA, 2867 nt, Artificial Sequence
  mRNA product Design3 comprising derived and/or modified sequence from Homo sapiens__NP_055093.2 __HsHSPA4L (opt11)
gggagagucccgcagucggcguccagcggcucugcuuguucgugugugugucguugcaggccuuauucaagcuuaccaugucagucgucggcaucgaucucggguuccugaacugcuacauagcagucgcccggaguggagggaucgagacaauagcaaacgaauacucggaccgcugcacacccgcaugcauaagccucggcuccagaacgagagccaucgguaacgccgcuaagagccaaaucguaaccaacguacgcaacacaauccacggcuuuaagaaacuccacggcagaucguuugacgacccuauaguccagacagagcgcauacgacugcccuacgaacuacagaaaaugccaaacgggagcgcgggcgucaaaguccgauaccuagaagaggagcgcccauucgcaauugaacaaguaacuggaaugcugcuagcaaaauuaaaagaaacgagcgaaaacgcccuaaagaaacccguagccgauugcguuaucucaauaccgagcuuuuucacagacgcagagcggcgcucagucauggccgcagcccaagucgccggccucaacugccuccgccucaugaacgaaacaacugccguugcccuggccuacggcaucuacaaacaagaccuaccgccccuggacgagaaaccgcgaaacgucgucuuuaucgacaugggacacuccgcauaccaaguucuaguaugcgccuucaacaaaggcaagcucaaaguacuggcaaccacauucgaccccuaccucgguggacgaaacuucgaugaagcgcucgucgacuacuucugcgacgaguucaaaacgaaauacaaaaucaacgucaaggagaacucccgggcccugcuaagacucuaccaagagugcgaaaaacuaaagaaacuuaugucggcaaacgccucagaccugccccucaacauagaauguuucaugaaugaccucgacguaagcuccaaaaugaaccgcgcacaauucgagcaacuaugcgccagccugcuagccaggguagaaccuccacuaaaagcagucauggagcaggcuaaccuacaacgcgaggacauaagcagcaucgagaucgugggaggcgccacacgcauacccgcagucaaagaacaaaucaccaaauuuuuccuaaaagacaucucaaccacccucaacgccgacgaagcaguagcgcgcggcugcgcccuccaaugcgcgauacucagcccagccuucaagguacgcgaguucaguaucaccgaccucguccccuacucaauaacacuaagauggaaaaccucguucgaagacggcuccggagaaugcgaaguauucugcaagaaucacccggcaccguucucgaagguaaucaccuuccacaagaaagaacccuucgaacuugaagcauucuacacaaaucuucacgagguaccauacccggacgcacgcauaggcucauucaccauccaaaacgucuucccccaauccgacggcgacucaagcaaagugaaagugaaaguccgcguaaauauccacggaauauucuccguagcaagcgcaucaguaaucgagaaacaaaaccucgaaggcgaccacagcgacgcaccaauggagaccgaaaccagcuucaagaacgagaacaaggacaauauggacaaaaugcaaguagaccaggaagaaggacaccagaaaugccacgcagaacacacccccgaggaagaaaucgaccacacaggcgccaaaacaaaauccgccguaagcgacaaacaggaucgccuaaaccagacgcucaaaaaggggaaagugaaauccauagaccuacccauccaguccucacuuugccgccagcuaggccaggaccuucugaacucauacaucgaaaacgaggggaaaaugaucaugcaagacaaacucgaaaaggaaaggaaugacgccaaaaacgcagucgaagaauacguauacgacuuccgcgaccgacugggcacaguauacgaaaaauucauuacacccgaagaccucaguaagcuaagcgcggucuuggaggacaccgagaacuggcucuacgaagacggcgaggaccagcccaaacaaguauacguggacaaacuacaagaacucaaaaaguacggacaaccuauccaaaugaaguacauggaacacgaagaacgcccaaaagcucuaaacgaccuaggcaagaagauacagcucguaaugaaggucaucgaagccuaccgcaacaaagacgaaagauacgaccaccuagacccaaccgaaauggaaaaaguagaaaaaugcauaagcgaugcaaugagcuggcucaacucuaagaugaaugcacaaaacaaacucucccuuacccaagacccagucguaaaagucucagaaauugucgcgaaaagcaaagagcuagacaacuucugcaaucccaucaucuacaagcccaaacccaaagcagaaguacccgaagacaaacccaaagccaacuccgaacacaacggcccgauggacggccaaagcggaaccgaaacaaaguccgacaguaccaaagacagcucgcagcacaccaaguccuccggcgaaauggaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4782 - RNA, 2312 nt, Artificial Sequence
  mRNA product Design3 comprising derived and/or modified sequence from Homo sapiens__NP_005338.1__HsHSPA5 (opt11)
gggagagucccgcagucggcguccagcggcucugcuuguucgugugugugucguugcaggccuuauucaagcuuaccaugaaacuaagccuggucgcagcaaugcugcuacuacuaagcgcagcaagggcagaggaagaagacaagaaagaggacgucggcacaguagucggaauagaccuggggacgaccuacagcuguguaggggucuucaagaacggcagaguugaaaucaucgcaaacgaccaaggcaaccgaauaacaccgagcuacguagcguucacacccgaaggcgaaagacucaucggggacgcagccaaaaaccaacuaacaagcaacccggaaaacacaguguucgacgccaaaagacuaaucggcagaaccuggaacgaccccuccguccaacaagacauaaaauuccucccauucaaagugguagaaaagaaaacgaaacccuacauacaagucgacauagggggcgggcagacaaaaacauucgcgccagaagaaaucagcgcaaugguccuaaccaaaaugaaagaaacggcagaagcguaccugggaaagaaagucacccacgccgucgucacgguccccgccuacuucaacgacgcgcaacgacaagcaaccaaagacgcaggcacgaucgcgggacugaacguaaugaggauaaucaacgaaccaacagcagccgccaucgcauacggacuggacaagcgcgaaggagagaaaaacauacuggucuucgaccugggcggaggaacauucgacgucucgcuacugacaauagacaacggcguauucgaggucguggcuacgaacggagacacacaccuaggaggggaagacuucgaccaacgagucauggaacacuucauaaaacuauacaagaagaaaaccggaaaagacguaagaaaagacaacagagccguacaaaaacugaggcgcgaaguagaaaaagcgaaacgggcccugagcucgcaacaccaagcgagaauagaaauagaguccuucuacgaaggagaagacuucagcgaaacacuaacgcgcgccaaauucgaagaacucaacauggaccucuuccgcucaacuaugaagcccguccaaaaagugcucgaagacagcgaccugaaaaagagcgauaucgacgaaauaguacugguaggcggaagcacacggaucccaaaaauacagcaacucgugaaagaguucuucaacggaaaagaaccaucgcgagggaucaacccagaugaagcggucgcauacggugcagcgguccaggccgggguacuaagcggagaccaagacacaggagaucugguacuccuugacgugugcccacuaacccucgggauagagaccguaggcggcguuaugacaaaacugaucccccgcaacaccguaguacccacgaagaaaagccaaaucuucagcacggcaagcgacaaccaaccgaccguaaccauaaaaguguaugagggggaacgaccccucacgaaagacaaccaccuacucggcacauucgaccucacaggaauaccaccagccccgcgcggaguaccacaaaucgaaguaacguucgaaaucgacgugaacggaauccuacgcgucaccgccgaggacaaagggaccggcaacaagaacaaaaucaccaucacgaacgaccaaaaccgccucacaccggaggaaaucgaacguauggucaacgacgcggaaaaguucgcggaagaggacaagaaacucaaagaacgcauagacacgcgaaacgaacuggaaucauacgcauacucacugaaaaaccaaauaggagacaaggaaaagcuaggaggcaagcuaucgagcgaggacaaagaaacaauggaaaaggcagucgaggagaaaauagaauggcuagaaucccaccaagacgcagacauagaagacuucaaagcgaaaaagaaagaguuagaagaaaucguucaaccaaucaucagcaaacuauacgguagcgcaggcccaccgccuacaggcgaggaagauaccgcagaaaaagacgagcuguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4783 - RNA, 2279 nt, Artificial Sequence
  mRNA product Design3 comprising derived and/or modified sequence from Homo sapiens__NP_002146.2__HsHSPA6 (opt11)
gggagagucccgcagucggcguccagcggcucugcuuguucgugugugugucguugcaggccuuauucaagcuuaccaugcaagccccacgagagcuagcaguaggaauagaccucggaacuacauacucaugcguaggcguauuccaacaaggacgcguagaaauacucgcaaacgaccaaggcaaccgcaccacgccaagcuacgucgccuuuaccgacaccgagagacucguaggcgacgcagccaaaucgcaggccgcccucaauccccacaacaccgucuucgacgcgaaaagacuaaucggccgaaaauucgccgauaccacaguccaaagcgacaugaaacacuggcccuuucgcguagugucagaaggaggaaaaccaaaagucagggucugcuaccgaggagaagacaaaaccuucuacccagaagagauaucgaguaugguacuauccaaaaugaaggaaaccgcagaagccuaccuaggacaaccaguaaagcacgccgucauaacaguaccagcguacuucaacgacagccaaagacaagccaccaaggacgccggggccauagccggacuaaacguccuccgcauaaucaacgaaccgaccgcugccgcgaucgcauacggccucgaccgcaggggagcuggcgaaagaaacguccucaucuucgaccucggagggggaacauucgacgucucaguacuaaguauagacgccggcguauuugaaguaaaagccacagcaggcgacacccaccuaggaggagaagacuucgacaaccgacucgugaaccacuucauggaagaguuccgacgcaaacacggcaaagaccucuccggcaacaaacgggccuugagacgacucagaacagccugcgaaagagcaaaaagaacacucagcucaagcacacaagcgacauuagaaauagacucccuauucgagggcguagacuucuauaccucgaucacacgcgcaagauucgaggaacugugcucagaccucuucagaucaacccucgaaccggucgagaaagcucuaagagacgccaaacuagacaaagcacaaauccacgacgucgucuuaguaggcggaagcacccgaauaccaaaagugcaaaaacuccuacaagacuucuucaacggaaaggagcucaacaagucaauaaaccccgacgaagccgucgcauacggggccgcaguacaggccgcagugcucaugggcgauaaaugcgagaaaguccaagaccuucuacuacucgacguagccccacuuucccuagggcucgaaaccgcgggcgggguaaugaccacccucauccaacgaaacgcaacaauaccaacuaaacaaacccagaccuucacaacauacucagacaaucaaccgggaguauucauacaagucuacgaaggcgaacgagccaugacaaaagacaacaaccuucucggcagguuugaacucagcggcauacccccagccccacgcggcgucccacaaauagaagucaccuucgauauagacgccaacggcauacucagcguaacggcaaccgaccgcagcaccggaaaagcgaacaagauaaccaucacaaacgacaaagggcgccuaagcaaagaagaggucgagcgcaugguccaugaagcagaacaguauaaagcagaggacgaagcccaacgagacagaguagcagcgaaaaacagucucgaggcacacguguuccacgucaaaggcucacuacaagaagagagccuacgagacaaaauccccgaagaagacaggcggaaaaugcaagauaaaugccgcgaaguacucgcuuggcucgagcacaaccaacuggccgaaaaggaggaauacgaacaccaaaaacgagaacucgagcagauaugccgacccauauucucccgccucuacggcggccccggcguccccggaggaagcagcugcggcacgcaagccagacaaggagaccccucaaccggacccauaaucgaagaaguggacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4784 - RNA, 1451 nt, Artificial Sequence
  mRNA product Design3 comprising derived and/or modified sequence from Homo sapiens__P48741__HsHSPA7 (opt11)
gggagagucccgcagucggcguccagcggcucugcuuguucgugugugugucguugcaggccuuauucaagcuuaccaugcaagccccccgcgaacuagccguaggcaucgaccucggcacaaccuacagcugugucggcguauuccaacaaggcagaguagaaauccuagccaacgaccaaggcaacagaacgaccccaucauacgucgcguucaccgacacagaaaggcuaguaggagacgcagcaaaaucccaagcagcccuaaacccgcacaacacuguauucgacgccaaacgccuaaucggacgaaaauucgcagacacaaccguccaaucagacaugaaacacuggccauuccaagucgucuccgaagguggaaaacccaaaguacgaguaugcuaccgaggggaagacaaaacauucuacccagaagaaauaagcucaaugguacuaagcaaaaugaaagaaaccgcggaagccuaccuaggccaaccaguaaaacacgccguaaucacggucccgaccuacuucagcaacucccagagacaggccaccaaagacgcaggagcaaucgcaggccuaaaaguacucccaaucauaaacgaagccacagccgcagcaauagccuacggccuggaccgaagaggagccggcaaacgaaacguacucauauucgaccuaggaggaggaacauucgacguauccguacucucgaucgacgccggggucuucgaaguaaaagcuaccgccggcgacacccaccuaggaggcgaagacuucgacaaccgccuagucaaccacuucauggaagaauuccgcagaaaacacggcaaagaccuaagcggaaacaaacgagcccucagacgacuccgaacagccugcgaacgagccaaacgcaccccaucaagcagcacccaggccacacuagaaaucgacucccuauucgaaggcguagacuucuacaaaagcaucaccagagccagauucgaagaacucugcagcgaccuauuccgaagcacccuagaacccguggaaaaagcccuccgcgacgccaaacuagacaaagcacaaauccacgacuucguacuaggcggcgggcuccacagccacccacaaggcgcagaagucgccgcaggccuacuccaacgacaaggcgcagaacaagaacaccagccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4785 - RNA, 2288 nt, Artificial Sequence
  mRNA product Design3 comprising derived and/or modified sequence from Homo sapiens__NP_006588.1 __HsHSPA8 (opt11)
gggagagucccgcagucggcguccagcggcucugcuuguucgugugugugucguugcaggccuuauucaagcuuaccaugucaaaaggacccgcagugggaaucgaccuaggcaccaccuacucaugcguaggcgucuuccaacacggaaaagucgagauaaucgccaacgaccaaggaaacaggacgacaccaucauauguagccuucaccgacaccgagcgccuaauaggagacgccgccaaaaaccaggucgcaaugaacccaacgaacaccguauucgacgccaaacgacuaaucggccgccgauucgacgaugcagucguccagagcgacaugaaacacuggcccuucaugguaguaaacgacgccggccgaccaaagguacaagucgaauacaaaggcgaaaccaaauccuucuaccccgaagagguguccagcaugguccucaccaaaaugaaagaaauagcagaagcguaccuggggaaaacagucaccaacgcaguagucaccguccccgcauacuucaacgacagccagagacaagcaacaaaagacgcaggcaccaucgccgggcuaaacguccuacgcauaaucaacgaacccacagcagcugcaaucgcauacggucucgacaagaaaguuggugccgaacgcaacguccuaaucuucgaccucgggggcggcaccuucgacguaucaauccucacaauagaagacggaauauucgaagucaaaagcaccgcaggcgacacccaccuaggcggcgaggacuucgacaacagaaugguaaaccacuucaucgcagaguucaaacggaaacacaagaaagacaucuccgaaaacaaacgcgcaguacgacgccuacggacagcaugcgaacgcgccaaacgcacccucuccuccuccacccaagcaagcauagaaaucgacagccuauacgaaggaauagauuucuacacauccaucacaagggcgcgcuucgaagaacuaaacgcagaccucuuccgagguacccucgacccagucgaaaaagcauuaagagacgcaaaacuagacaaaagccaaauccacgacauaguccuggugggcggaucaacccguaucccuaaaauccaaaaacuacuacaggacuucuucaacggaaaagaacuaaacaaguccaucaacccagacgaagcuguggcauacggcgcggccguacaagccgccauccuaagcggcgacaaaucggaaaacgugcaggaccugcuacuccuagacgucacaccccucucacuaggcauagaaaccgcgggcggcguaaugaccguccuaauaaaacgaaacacaaccauaccaaccaaacaaacgcaaaccuucacaacauacagcgacaaccaaccagggguacucauccaaguauacgaaggcgaacgcgcaaugaccaaagacaacaaccuccuaggcaaauucgaacuuacaggaaucccacccgcaccccgagggguaccccaaauagaaguaacauuugacauagacgccaacggcauccuaaaugucagcgccgucgacaaaagcaccggaaaagaaaacaaaauaacgauaaccaacgacaaaggccgacugagcaaagaagacaucgagcgaaugguacaagaagccgaaaaauacaaagcagaggaugaaaaacagcgcgacaaaguaucaagcaaaaacagucuggaaagcuacgccuucaacaugaaagcaacaguggaagacgaaaaacuccaaggcaagaucaaugacgaagacaagcagaaaauccucgacaaaugcaacgaaaucaucaacuggcucgacaagaaccaaacagcagaaaaggaagaguucgaacaccaacagaaagaacucgaaaaagucugcaaccccauaaucacaaaacuguaccaauccgcaggcggaaugcccggcggcaugcccggaggauucccaggcggcggggcaccacccaguggcggagccagcucaggaccgacaaucgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4786 - RNA, 2387 nt, Artificial Sequence
  mRNA product Design3 comprising derived and/or modified sequence from Homo sapiens__NP_004125.3 __HsHSPA9 (opt11)
gggagagucccgcagucggcguccagcggcucugcuuguucgugugugugucguugcaggccuuauucaagcuuaccaugauaagcgccucaagagcagcagccgccagacugguaggagccgcagcaucaaggggcccgacagcagccagacaccaagacucauggaacggccuaagccaugaagcauuccgccucguaagccgacgcgacuacgcgagcgaagcaauaaaaggagccguggucggcauagaccuaggaaccacgaacucgugcguggccguaauggagggaaaacaagcaaaaguacucgaaaacgccgaaggggcaagaacaacgcccucaguaguagcguucacugcggacggcgaaaggcuaguaggcaugccagcaaaacgacaagcggugacaaacccaaacaacacguucuacgcaacaaaacgacucauaggacgacgauacgacgacccggaaguacaaaaagacaucaaaaacgucccguucaaaauagugcgcgccaguaacggagacgccugggucgaagcccacggcaaacucuacagcccaucccagaucggcgccuucguccuaaugaagaugaaagagaccgccgaaaacuaccucggacacacagcuaaaaacgcagucaucacugugccagcguauuucaacgacagccaaaggcaagccacgaaagacgccgggcaaauaaguggacuaaacguccuaagggucaucaacgaaccgacugcagcggcccuggcauacggccuagacaagagcgaagacaaaguaauagccguauacgaccuaggaggcgggacauucgacauaagcauccuagaaauacagaaaggaguauucgagguaaaaagcacgaauggggacacguuccuggguggcgaagacuucgaccaagcacugcuacgccacaucgugaaggaguucaaacgagaaacaggggucgaccucacaaaagacaacauggcgcuccaacgaguccgcgaagcagcggaaaaagcaaaaugcgaacuaagcagcagcguacaaaccgacauaaaccuacccuaccuaacaauggacaguagcgggccaaaacaucucaacaugaaauuaacaagagcucaauucgaaggcaucguaacggaccuaauacgacgaaccaucgccccgugccaaaaagccaugcaagacgcagaaguaagcaagagcgacauaggagaaguaauacugguaggcggcaugacaagaaugccgaaaguacaacaaaccguacaagaccuauucggacgagcaccaagcaaagccgucaacccggaugaagcaguggccauuggcgcagcaauccagggaggcgugcuagcgggcgauguaacagacguacuccuacuagacguaaccccgcuaagccuaggaauagaaacccuaggcggaguauucacaaagcugauaaacagaaacacaacaaucccaaccaagaaaagccaaguauucagcaccgcggcagacgggcaaacccaaguggagaucaaagucugucaaggagaacgagagauggccggcgauaacaaacugcucggccaauucacccugaucggcauaccacccgcgccgagaggaguaccccaaaucgaggucacguucgauaucgacgccaacggcauaguccauguaagcgccaaagacaaaggaaccggacgcgaacaacaaauagucauccaaucaagcggaggccuaagcaaagacgacaucgagaacauggucaaaaacgcggaaaaauacgcagaggaagaccgaagaaagaaagaaagagucgaagcaguaaacauggccgaaggaauaauacacgacaccgaaaccaaaauggaagaguucaaagaccaacuaccagcugacgaaugcaacaaacucaaagaagaaauaaguaaaaugcgagagcuacuagcgcgcaaagacagcgaaacgggagaaaauauacgccaggcagcgagcagccugcaacaagcuagccuaaaacuguucgaaauggccuacaagaaaauggcauccgaaagggaaggaagcggaagcagcggcaccggcgaacagaaagaagaccaaaaagaagagaaacaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4787 - RNA, 2375 nt, Artificial Sequence
  mRNA product Design3 comprising derived and/or modified sequence from Homo sapiens__NP_079291.2__HsHSPA12A (opt11)
gggagagucccgcagucggcguccagcggcucugcuuguucgugugugugucguugcaggccuuauucaagcuuaccauggcagauaaagaagcaggcggauccgacgggccacgagaaaccgccccaacauccgcauacagcucgccagcccgaucacuaggagacaccgguauaacgccccuuucccccucccacaucgucaacgacaccgacucaaacguauccgaacaacaauccuucuuaguugucguggccgucgacuucggaacaacaucauccggcuaugccuauucauucaccaaagaaccggagugcauccacgucaugcgucgcugggaaggaggagaccccgggguuucaaaccagaaaacccccaccaccauccuucucacccccgaacggaaauuccacuccuucggcuacgccgcccgggacuucuaccacgaucuagacccgaacgaagcaaagcaauggcucuaccuagaaaaauucaaaaugaaacuucacaccaccggcgaccucacaauggauacagaccuuacagccgcaaacggcaagaaagucaaagcgcucgaaaucuucgccuacgcacuccaauacuucaaagaacaagcccucaaagagcuauccgaccaagccggcucagaguucgaaaacucagacguccgcugggucauaacaguaccugcgauauggaaacaacccgccaaacaguuuaugagacaagcagccuaccaggcuggacuggcauccccugaaaacucagaacaacucauaaucgcgcuagaacccgaagcugcaagcauauacugccgaaaacuccgccuccaccagaugaucgaacugagcuccaaagcagccguaaacggauacagcggcuccgacacugucggcgcaggauucacccaagcuaaagaacacauccgacgaaaccgccagucacgcacuuuccuagucgaaaacgucauaggagaaaucuggagcgaacuagaagaaggagacaaauacgucguggucgauucaggcggcggcaccgucgaccuaacaguccaccaaaucaggcuaccagagggccaccucaaagagcuauacaaagcaaccggcggccccuacggaucccucgguguagacuaugaguucgagaaacugcucuacaaaauauuuggcgaggacuuuaucgagcaauucaaaaucaaacgccccgccgccugggucgacuugaugaucgccuucgaaagccgaaaacgcgccgccgcccccgacagaacaaacccacuaaacaucaccuuacccuucucguucaucgacuacuacaagaaauuucgcggccacuccgucgagcacgcccuacgaaaaagcaacgucgacuucgucaaauggucaucgcaaggaaugcuccguaugucccccgacgccaugaaugcccuauucaaacccacaauagacuccaucaucgaacaccuccgcgaccucuuucaaaagccagaaguaucaaccgucaaauuucucuuccuagucggcggcuucgcagaagcaccccuacuccaacaagccguucaagccgcuuucggcgaccaaugcagaaucauaaucccacaagacguaggacucaccauucucaaaggcgccguacuuuucggccucgacccagccgucauuaaagugcgaagauccccucugacauacggcgucggaguccuaaaccgcuacgucgaaggaaaacacccacccgaaaaacuucuagucaaagacggcacccgauggugcaccgacguauucgauaaauucauaucagcagaccaaagcgucgcccucggcgagcuagucaaaagauccuacacacccgccaaaccaagccaacucgucaucguuaucaacauauacuccagcgaacacgacaacguaucguucauaaccgaccccgggguaaagaaaugcggcacccuccgccucgaccuaacaggcaccucaggcaccgccgucccagcacgcagagaaauacaaacccucaugcaguucggugacaccgaaaucaaagccaccgccaucgacauagcaaccaguaaaucggucaaaguaggcauagacuuucuaaacuacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4788 - RNA, 2408 nt, Artificial Sequence
  mRNA product Design3 comprising derived and/or modified sequence from Homo sapiens__NP_443202.3 __HsHSPA12B (opt11)
gggagagucccgcagucggcguccagcggcucugcuuguucgugugugugucguugcaggccuuauucaagcuuaccaugcuagccgucccagaaaugggcuuacaaggacuuuacaucggaagcuccccagaacgaucacccguacccagcccacccggaucaccccgcacccaggaaucaugcggaaucgcgccccugacacccagccaaagcccaaaacccgaaguacgggccccgcaacaagccuccuucagcguagucguggccauagacuucggaacgaccagcaguggcuacgcauucucauucgcaagcgauccagaggccauacacaugaugcgaaaaugggaaggcggcgacccaggaguagcacaccagaaaaccccaacaugccuacuccuaacccccgaaggcgccuuccacucauucggcuacacugcaagagauuacuaccacgaccucgacccggaagaagcccgcgacuggcucuacuucgagaaauucaagaugaaaauccacagcgccacagaccuaacacugaaaacccaacucgaggcggugaacggcaagacaaugccagcacucgaaguauucgcacacgcccuccgauucuuccgcgaacacgcacuacaagaacuacgcgaacaaagccccagucugcccgagaaggacaccguccgguggguguuaaccguacccgcaaucuggaaacaaccagcaaaacaauucaugcgcgaagccgccuacuuagccggacuuguaagcagagagaacgcagaacaacuccucauagcccuggaacccgaagccgccuccguauacugccgaaaacuacgacuacaccaacuacuagaccugucgggccgcgcccccggcggcggccgccuaggcgaaagacgaagcauagacuccuccuuccgccaagcccgagaacaacuaagaagauccagacacucacgaaccuuccuaguagaauccggagucggagaacuaugggccgaaaugcaagccggcgaccgcuacguagucgccgacugcggagggggcacugucgaccuuaccguacaccaacuagaacaaccacauggcacccuaaaagaacuauacaaagccucgggaggucccuacggggcugucggcguagaccucgcauucgagcaacuccuaugccgcaucuucggagaagacuucaucgcaacauucaaacgccaaaggcccgccgcaugggucgaccucacuaucgccuucgaagcacgaaaacgaacagcaggaccccaucgcgcaggcgcccucaacaucucacuacccuuuuccuucauagacuuuuacagaaaacaaagagggcacaacguagagacagcacucagacgauccagcgugaacuucguaaaauggucaucccaagggaugcugcgaaugucaugcgaagcaaugaacgagcuauuccaaccaacaguaucaggcauaauccaacacaucgaagcacugcucgcccgaccagaaguacaaggcguaaagcuccucuuccuagucggcggauucgccgaaagcgcaguccuccaacaugccguccaagccgcccugggcgcacgcggacuacgagucgucguaccacacgacgucggacucacgauacucaaaggagccguacuauucggacaagccccaggaguaguccgcguccgccguucgccgcucaccuacggcgucggcguccucaacagauucguaccaggacgccaucccccagaaaaacugcugguccgcgacggccgcagaugguguacagacgucuucgaacgcuucguagcagccgagcaauccgucgcgcuaggagaggaaguccgccguucauacugucccgccagacccggccaacgaagaguacucaucaaccuauacugcugcgcagcagaagacgcacgcuucauaacugacccaggcguccggaaaugcggcgcccucucacuagaacucgaacccgccgacugcggacaggacaccgcaggagccccacccggacgacgcgaaauucgggccgccaugcaauucggcgacaccgaaaucaaggugacagccguggacgucagcacgaaccgcagcguuagagcaagcauagacuuccucucaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4789 - RNA, 1763 nt, Artificial Sequence
  mRNA product Design3 comprising derived and/or modified sequence from Homo sapiens__NP_008879.3__HsHSPA13 (opt11)
gggagagucccgcagucggcguccagcggcucugcuuguucgugugugugucguugcaggccuuauucaagcuuaccauggcccgcgaaaugaccauccucggcucagccguccuuacccuacuacuagcgggauaccuagcccaacaauaccuuccacuacccacccccaaagucauagguauagaccucggaaccaccuacugcuccgucggcgucuucuuucccggaaccggaaaagucaaagucaucccagacgaaaacggacacaucucuauccccucgauggucagcuucacagacaacgacguauacgucggcuacgaauccgucgagcuagccgacagcaacccacaaaacacaaucuacgacgccaaacgcuucaucggcaaaaucuucaccgccgaagaacucgaagccgaaaucggacgcuaccccuucaaaguacucaacaaaaacggcauggucgaguucucaguaaccagcaacgaaaccauaaccguaucccccgaauacgucggcucacgcuuacuacuaaaacucaaagagauggcagaggcuuaccucggcaugccggucgccaacgcugucauaagcguccccgcggaguucgaccucaaacaacgcaacuccaccauugaagcagcgaaccuggcaggacuaaaaauccuccggguaauaaacgaacccacagcagcagccauggccuacggacuccauaaagccgacgucuuucacguucuagucaucgacuuaggcggaggcacccucgacgucucccuccucaacaaacagggcggaauguuccuaacacgcgccaugucaggcaacaacaaacucggcggccaggacuucaaccaacgccuacuucaauaccucuacaaacagaucuaccagaccuauggauucguacccucucggaaagaagaaauccaccgccuccgccaagccguagaaaugguuaaacucaaccucacccuacaccagucagcgcaacuauccguccuccucacggucgaagaacaagaccgcaaagaaccccacucaucagacaccgaacuccccaaagacaaacucuccucagccgacgaccaccgcgugaacucaggcuucggccgcggccuauccgacaagaaauccggcgaaucucaaguacucuucgagacagaaauaagccgcaaacucuucgacacccuaaacgaagaccucuuccagaaaauacucguacccauccaacaaguccuaaaagaaggccaccuugagaaaaccgaaaucgacgaagucguucucgucggcggcuccacccgcaucccccguauucgacaagucauacaagaauuuuucggaaaagaucccaacacuagcgucgaccccgaccuugcaguagucacagggguagccauccaagccggaauagacggcggauccuggccccuucaagucuccgcacucgaaauccccaacaaacaccuucagaaaaccaacuucaacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4790 - RNA, 1877 nt, Artificial Sequence
  mRNA product Design3 comprising derived and/or modified sequence from Homo sapiens__NP_057383.2__HsHSPA14 (opt11)
gggagagucccgcagucggcguccagcggcucugcuuguucgugugugugucguugcaggccuuauucaagcuuaccauggccgccaucggaguccaccucggcugcacauccgccugcguggccgucuacaaagacggacgcgcaggcguagucgccaacgacgccggagaccgcgucacccccgccguagucgccuacagcgaaaacgaggaaauagucggacucgccgccaaacaaucccgaauacgcaacauauccaacacaguaaugaaagucaaacaaauccucggacgaagcagcagcgacccacaagcccaaaaauacaucgccgaauccaaaugccuugucaucgagaaaaacggaaaacuacgauacgaaaucgacacaggggaagaaaccaaguucgucaacccagaggacgucgcacgccucaucuucagcaaaaugaaggagaccgcacauagcguacuaggguccgacgccaacgacgucguaauaaccgucccauuugacuucggcgaaaaacaaaagaacgcacuaggcgaagccgcccgcgccgcuggcuucaacguccugcgacuaauacacgaaccaucagcagcacuacuagccuacggcaucggacaagacucaccaacaggcaaaucaaacauacucguauucaaacucggaggcacuagccuaucacuauccguaauggaggugaacagcggcaucuaccgcguacucaguaccaacacagaugacaacauaggcggcgcccacuucacagaaacccuagcgcaauaccuagcgucggaauuucaacgcagcuucaaacacgacgucagaggaaacgcccgcgcgaugaugaaacuaaccaacagcgcggaagucgcaaaacacucccucucaacccucggcuccgccaacugcuuccucgacucacucuacgaaggccaggacuucgacugcaacgucucaagagcccgcuucgaacuccugugcuccccacuauuuaacaaauguaucgaagcaauacgcggacuccuagaccaaaacggcuucacagccgacgacaucaacaaagucguccucugcggcggcagcucgcgcauccccaaacuccaacaacuaaucaaagaccucuucccagccgucgaacuacucaacucgaucccacccgaugaaguuauucccauuggagccgccaucgaagccggcauccuaaucggcaaagaaaaccuacugguagaagacucacuaaugaucgaaugcucagcccgcgacauccucgucaaaggagucgacgaaagcggagccucccgauucaccguacuauucccuuccggaacgccgcucccagcccgccgacaacacacccuccaagcccccggcuccaucuccuccgucugccucgaacucuacgaaagugauggcaaaaacucagccaaagaagaaaccaaauucgcgcaaguaguacuacaagaccucgacaagaaagaaaacggacuacgcgacauccuagccguacucaccaugaaacgcgacggaucacuccacguaaccugcacagaccaagaaacaggcaaaugcgaagcuaucuccauagaaaucgccucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4791 - RNA, 2924 nt, Artificial Sequence
  mRNA product Design3 comprising derived and/or modified sequence from Homo sapiens__NP_006635.2 __HsHSPH1 (opt11)
gggagagucccgcagucggcguccagcggcucugcuuguucgugugugugucguugcaggccuuauucaagcuuaccauguccgugguaggacucgacgucgggagccaaagcugcuacauagcgguagccagggcaggcgggauagagacgaucgccaacgaguucuccgaucgcugcacacccagcgucaucagcuuugguucuaaaaacaggacuauaggaguggccgccaaaaaccaacaaauaacccaugcaaacaacaccgucagcaacuucaaacgauuccacggacgugccuucaacgaccccuuuauacaaaaagaaaaagaaaaccuauccuacgaccuagucccccucaagaauggaggcgugggcaucaaaguuauguauaugggagaagaacaccuguucucaguagaacagauaaccgccaugcuacuaacaaaacugaaggaaaccgcagagaacagucugaagaaaccugucaccgacugcguaaucuccguacccuccuucuucaccgacgcagaacggagauccguacuagacgcagcccaaauaguaggccuaaacugccuccgccugaugaacgauaugacggccguagcacucaacuaugggauuuacaaacaagaccucccaagccucgacgaaaaaccccgcauaguagucuucgucgacaugggacacucagcauuccagguaagcgcaugcgccuucaacaaaggaaaacucaaaguccuaggcacggcuuucgaccccuuccuaggcgggaaaaauuucgacgagaaacucgucgaacacuucugcgccgaguucaaaaccaaauacaaacucgacgcaaagagcaaaauccgagcccuccuacgccuauaccaggaaugcgaaaagcuaaagaaacugauguccuccaacuccaccgaccuaccccuaaacaucgaauguuucaugaacgacaaggacgucagcggaaagaugaacagaucccaguucgaggagcucugcgccgagcuacuccaaaagauagaagucccccucuacagccuucucgaacagacccaccucaaaguagaagacguuucagccgucgaaaucgucggcggagcaacacgcauccccgcggucaaagaacgcaucgccaaauucuucgggaaggacauauccaccacccuaaacgcagacgaagcaguggcacgcgggugugcccuccagugcgccauccuaagccccgcauucaaaguacgagaguucucaguaaccgaugccgucccguucccaauaagccugauauggaaccacgacagcgaggacaccgaagguguccacgaagucuucagucgaaaccacgcggccccauucucaaaaguauuaacguuccuccgacgcggacccuucgaacucgaagcauucuacagcgacccgcaaggcguaccguacccugaggcaaagauuggcagguucguaguccagaacgucuccgcacagaaagauggcgagaaaagccgcguaaaggucaaaguccgagucaacacacacggaaucuucaccauuuccaccgccucaaugguagaaaaaguccccacagaagaaaacgagaugagcucugaagccgacauggagugccucaaccaacgcccacccgaaaaccccgacaccgacaagaacguccaacaagacaacagcgaagcaggaacccagccccaaguccaaaccgacgcacaacagaccagccagagcccacccucccccgagcucacaucagaagaaaauaagaucccagacgcagacaaggccaacgaaaagaaagucgaccagcccccggaggccaagaaacccaaaaucaaaguggucaacguagaacuccccaucgaagcaaaccuggucuggcagcuagguaaagacuuacuaaacauguacaucgaaaccgaaggcaaaaugauaaugcaagauaaacucgaaaaagaacgcaacgacgccaaaaacgcagucgaagaauacguauacgaguuccgggacaaacuaugcggcccauacgaaaaauucaucugugaacaagaccaccaaaacuuucuacgucuauuaaccgaaaccgaagacuggcucuacgaagaaggcgaagaccaagcaaaacaggcuuacgucgauaaacuggaagaacuaaugaaaaucggaacgccggucaaagugcgguuccaagaagcagaagaacgucccaaaauguucgaggaacucggacaaagacuccaacacuacgcgaaaaucgccgccgacuuccgcaacaaagacgagaaguacaaccacaucgacgaaucagaaaugaagaaaguagaaaagucggucaacgaaguaauggaauggaugaacaacguaaugaacgcccaagccaaaaagucccucgaccaagacccagucguccgagcacaagaaaucaaaaccaaaauuaaggaacugaacaauaccugcgagcccgucguaacgcaaccgaaaccaaaaauagaaucccccaaacucgaacgaacccccaacgggccgaacaucgacaagaaagaagaagaccucgaggacaaaaacaacuucggagcagaaccaccacaccaaaacggcgaaugcuacccaaacgagaaaaacagcgucaacauggaccucgauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4792 - RNA, 3347 nt, Artificial Sequence
  mRNA product Design3 comprising derived and/or modified sequence from Homo sapiens__NP_006380.1 __HsHYOU1 (opt11)
gggagagucccgcagucggcguccagcggcucugcuuguucgugugugugucguugcaggccuuauucaagcuuaccauggcagacaaggucaggcggcaacgaccacggaggcgcguauguugggcgcuagucgcaguccuacuugcggaccuacuggcacuaagcgacacgcuggcaguuauguccguagaccucggaagcgaaucgaugaaagucgcgaucgucaaacccggcgucccaauggaaauaguccuaaacaaggaaagccgcaggaagaccccggugauagugacacucaaagagaacgaacgcuucuucggagacucggccgcgagcauggccauaaagaaccccaaagcaacgcuaagauacuuccaacaccuccucgggaaacaagcagacaacccacacguggcacucuaccaggcaagguucccagaacacgagcugacauucgacccgcaacgccaaacgguacacuuccaaauaucaucacaacugcaauuuucacccgaagaaguccuaggaauggugcucaacuacuccagaucauuagccgaagauuucgccgaacaaccaauaaaagacgcagucauaacaguacccgucuucuucaaccaggcagaacgccgagcaguccuacaagccgcgaggauggcaggccuuaaaguccuccaacugaucaacgacaacaccgcaacagcacugagcuauggcgucuucagacggaaggacauaaacaccaccgcacagaauauaauguuuuacgacaugggaagcggauccacagugugcaccauaguaaccuaccaaauggugaaaacgaaggaggccggcaugcaaccucagcuccaaauccgagggguaggauucgaccggacacucggcgggcuagaaauggaacuacggcuaagagaaagauuagcgggacuguucaacgaacagcgaaaaggacaacgagcgaaagacgucagggaaaacccccgcgcgauggcaaagcuccuucgagaggcaaaccgccugaaaacagugcugucagcgaacgcggaccacauggcucaaauagaaggacucauggacgacgucgacuucaaagcaaagguaacacgagucgaauuugaagaacuaugcgcggaucuauucgaaagagugcccggacccguacagcaagcacugcaguccgccgaaaugucccuagaugaaauagaacaaguuauccuagucggcggcgccaccagaguaccacgagugcaggaaguacuacucaaagccguaggcaaggaggaacuagggaaaaacauaaacgccgacgaagcagcagcgaugggggcaguuuaccaagccgccgcacucagcaaggcauucaaagucaaacccuucgucguacgagacgccgucguauacccgauacugguagaguucacacgcgaaguggaggaggaaccaggaauacauagccugaaacacaacaagcgaguucucuucagccgaaugggccccuacccccaaagaaaagugaucaccuucaaccgguacagccacgacuucaacuuccacauaaacuacggcgaccucggauucuuggggcccgaagaccucaggguauucgggagccaaaaccugacaacagucaaacucaaaggcguaggcgacagcuucaaaaaguacccagauuacgaaaguaaaggcauaaaagcacacuucaaucuugacgaaagcggagugcucucgcucgaccgcguggagagcgucuuugaaacccuaguagaggacagcgccgaagaagaaagcacgcuaacaaagcugggaaacaccauauccucacuauucggagggggaacgacaccagacgcaaaagagaacggaaccgacaccguccaagaagaggaagagagcccagcugaaggguccaaagacgagccaggagaacaaguugaacuuaaagaagaagcggaggccccuguugaggacggaagccaaccgcccccacccgaacccaaaggcgacgccacaccagaaggcgaaaaggcaaccgagaaggaaaacggagacaaauccgaagcccaaaaaccaagcgaaaaagcagaggccggcccagaaggggucgcgcccgcaccggaaggggagaagaagcaaaaacccgcacgaaaacgcagaaugguggaagaaaucggaguagagcuagucguacuagaccuaccagaucugccggaagacaaacuagcacaaucaguucagaaacuucaagacuugacccuacgggaccuggaaaaacaagaaagagaaaaagcagccaacagucucgaagccuucaucuucgagacacaagacaaacuguaccaacccgaguaccaggaaguaagcacagaagaacagagagaagaaaucaguggaaaacugagcgcugcgucaacauggcuagaagacgaagggguaggugcaacaaccgucaugcuuaaagaaaagcucgccgaacugcgcaaacucugccaagggcuauucuuccgaguagaagagaggaagaaauggccagaaaggcuauccgcacuagacaaccuacugaaccacucgagcauguuccuaaagggagcaagacucauaccagagauggaccaaauauucaccgagguggaaaugacaacacucgaaaagguaauaaacgaaacgugggccuggaaaaacgccacacuagcagagcaagccaaacugccagcaacagagaaaccaguacugcuaucaaaggacaucgaagcaaaaaugauggcacuggacagagaggugcaauaccuccucaacaaagcaaaauucacaaaacccagaccacgaccaaaagauaagaacggaacacgcgcagagccaccccuaaaugcuucggcgagcgaucaaggggagaaaguaauacccccagccgggcaaaccgaggacgccgagccgaucuccgaacccgaaaaggucgaaacaggcucagaacccggggauacagaaccacuugaacucggcggacccggagccgagccagaacagaaggaacaaaguacagggcaaaaacgcccccugaaaaacgacgaacuauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4793 - RNA, 2546 nt, Artificial Sequence
  mRNA product Design3 comprising derived and/or modified sequence from Homo sapiens__NP_005339.3 __HsHSP90AA1 (opt11)
gggagagucccgcagucggcguccagcggcucugcuuguucgugugugugucguugcaggccuuauucaagcuuaccaugccagaagaaacccaaacacaagaucaaccaauggaagaagaagaaguggaaaccuucgcguuccaggcggaaauagcccaacuaaugucccucaucaucaacaccuucuacagcaacaaggaaaucuuccugcgagaacuuaucagcaacagcagcgacgcccucgauaagaucagauacgaaagccuaacugacccaagcaaacuagauagcgggaaagaacuccacaucaaccuaauacccaacaaacaagaccggacccucacaauaguagacaccggaaucggaaugacaaaggcggaccuuauaaacaaucugggaaccaucgcgaaaagcgggacaaaggcauucauggaagcgcuccaggcaggggcagacauaucaaugaucggccaauucggagucggcuucuacucagcguaccuaguagccgagaaaguaaccgucauaaccaaacacaacgacgaugagcaguacgcgugggagagcagcgcgggaggaucguucacagugagaaccgacacaggggaaccgaugggacgcggaacgaaaguaauacuacaccucaaagaagaccagaccgaauaccucgaagaaaggcgaauaaaagaaauagugaagaaacacucccaguucaucggauacccgauaacacuauucguggagaaagagcgcgacaaagaggucagcgacgacgaagcagaagaaaaagaagacaaagaagaggaaaaggaaaaagaagaaaaagaaagcgaagacaaaccagagaucgaagacgugggaagcgacgaagaagaagaaaagaaagauggagacaagaagaaaaagaagaaaaucaaagagaaauacauagaccaagaagaacuaaacaaaacgaaaccaaucuggacccggaacccagacgacauaaccaaugaagaauacggcgaguucuacaaaucacucacaaacgacugggaagaccaccucgccguaaaacacuucucgguagagggacaacuagaguuccgagcgcuccuguucgugccaaggcgagccccauuugaccuguucgagaauagaaagaagaaaaacaacauaaaacucuacguccgccgggucuucaucauggacaacugugaagaacuaauuccggaauaccugaacuucauccgcggcguaguggacagcgaagaccugccgcucaacaucucgagagaaauguuacaacaaagcaaaauccucaaaguaauaaggaagaaccucgugaagaaaugccuggaauuauucacagaacuagccgaagacaaagaaaacuacaagaaauucuacgagcaauucagcaaaaacauaaaacugggcauccacgaagacagccaaaaccgcaagaaacuauccgagcuccuacgcuacuacaccuccgcauccggggaugagauggugucacuaaaagacuacugcaccagaaugaaagaaaaccaaaaacacaucuacuacaucacgggcgaaacaaaagaccaaguagcgaacucagccuucgucgagcgccuacgaaaacacgggcuagaagucauauacaugaucgaaccaauagacgaauacugcguccaacaacucaaagaguucgaaggaaaaacccucgucagcguuaccaaagaaggcuuggagcuccccgaagacgaagaagagaaaaagaaacaagaagaaaagaaaaccaaauucgaaaaccugugcaaaaucaugaaggacauacuggaaaagaaaguagagaaggucguaguaucaaacaggcucgugaccagccccugcugcauagucacaucuaccuacggauggacggccaacauggaaagaauaaugaaggcccaagcacuccgcgacaacucgacaaugggcuacauggcggccaagaaacaccucgagaucaaccccgaccacuccaucaucgaaacgcucaggcagaaagccgaagcagacaaaaacgauaaauccgugaaggaccucguaauacuccuauaugaaacggcccuucuaagcagcggguucagccucgaagacccgcaaacgcacgcgaacaggaucuaccgaaugaucaaacucggccuugggaucgacgaagacgacccaacagcagacgacacgagcgcggccguaacggaagaaaugccaccacuagaaggcgacgacgacacgagcaggauggaggaaguggacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4794 - RNA, 686 nt, Artificial Sequence
  mRNA product Design3 comprising derived and/or modified sequence from Homo sapiens__NG_005218__HsHSP90AA3P (opt11)
gggagagucccgcagucggcguccagcggcucugcuuguucgugugugugucguugcaggccuuauucaagcuuaccauggacagcucaaaacuggacucgggcaagggccugcacauaaaccuggucccgaacaagcaaaaccaaacacucacgaucguggacacgcgcauaggcaugaccaagaccgaccucauaaacaaccucgggaccgugaccaagagcgggaccaaggccuucauggaggcccugcaagcggacgcggacauaagcaugaucggacacuucggcgugggcuucuacucggccuaccucguggccaagaaagugaccgugaucucaaaacacaacaacgacgagcaauacaccugggaaucgagcgcgggcgggagcuucaccgugcgcacggacgaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4795 - RNA, 2522 nt, Artificial Sequence
  mRNA product Design3 comprising derived and/or modified sequence from Homo sapiens__NP_031381.2__HsHSP90AB1 (opt11)
gggagagucccgcagucggcguccagcggcucugcuuguucgugugugugucguugcaggccuuauucaagcuuaccaugcccgaagaagugcaccacggggaagaggaagucgaaaccuucgccuuccaggccgagauagcccaacucaugagcuuaaucauaaacaccuucuacuccaacaaagaaaucuuccucagagaguugauaucaaacgcaagcgacgcccuggacaagauaagauacgaaagccuaacagacccaucaaaacuggacucaggaaaggaguuaaaaauagacaucaucccaaacccacaagaacgcacgcucacccucguggacaccggaauaggaaugacaaaagccgaccucauaaacaaucucggcacgauagccaagagcgggacaaaagccuucauggaggcccuacaagcaggagccgacauaagcaugaucggacaauucggcguaggcuucuacagcgcauaccucgucgccgaaaaggugguaguaaucacaaaacacaacgacgacgaacaauacgccugggaaagcagcgccggcgggagcuucacagucagagcagaccacggcgaaccuauaggacgcgggacuaaaguaauccuccaccuaaaggaagaccaaaccgaauacuuagaagagcgcagggucaaggaagucgucaaaaaacacagccaguucaucggcuaccccauaacccucuaccuggaaaaagagagggaaaaggaaauaagugacgacgaggccgaggaagaaaaaggagaaaaagaagaagaagacaaagacgacgaagaaaagcccaagaucgaagacguaggaagcgacgaagaagacgacucaggaaaggacaagaaaaaaaaaacgaaaaaaaucaaagagaaauacaucgaccaagaagagcugaacaaaacaaaaccaaucuggaccaggaaccccgaugacaucacacaagaagaauacggggaauucuacaaaucgcuaacaaacgacugggaggaccaccucgcgguaaagcacuucagcguggaaggacaacucgaauucagagcacuacuauucaucccaaggagagcgccauucgaccuguucgaaaacaagaaaaaaaaaaacaacauaaagcuauacguccgacgagucuucauaauggacucaugcgacgaacugaucccagaauaccuaaacuucauccggggcguaguagacuccgaagaccucccacucaacaucagccgagaaaugcuacaacagagcaagauacugaaagugaucagaaaaaacaucguaaaaaagugccuagaacuauucagcgaauuagcagaggauaaagaaaacuacaagaaauucuacgaagccuucagcaagaaccuaaaacugggcauacacgaagacagcaccaaucgaaggcgccuaagcgaacuacuaagauaccacacaagucagagcggcgacgagaugacgagccuauccgaauacguuagccggaugaaagaaacgcaaaagucaauauacuacaucaccggagagagcaaggaacaaguagcgaacucggcauucgucgaacgcgugcgaaagcgcggauucgaagucguauacaugacggagcccaucgacgaguacuguguacaacagcucaaagaauucgacggcaaaagccuagucucaguaaccaaagaaggacuagaauugcccgaagacgaagaagagaagaaaaaaauggaagaaucaaaagccaaauucgagaacuugugcaagcugaugaaagagauccuagacaaaaagguagaaaaggucacgaucucaaaccggcuggugagcucgcccugcugcaucgucacgagcacauacggcuggacagcaaacauggaacgaauaaugaaagcacaagcccucagagacaacucaaccaugggguacaugauggccaagaaacaccucgaaauaaaccccgaccacccuauaguagaaacgcucaggcaaaaggccgaagcagacaaaaacgacaaagccguaaaagaccucgugguccugcucuucgaaacagcccuacucucaagcggauuuucacuggaggacccacaaacccacagcaacagaaucuaccgaaugauuaagcucggacuggguauugacgaggacgaaguagccgcggaagagcccaacgcggcaguccccgacgaaaucccgccccuggaaggggacgaggacgcaucaagaauggaagaggucgacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4796 - RNA, 2759 nt, Artificial Sequence
  mRNA product Design3 comprising derived and/or modified sequence from Homo sapiens__NP_003290.1__HsHSP90B1 (opt11)
gggagagucccgcagucggcguccagcggcucugcuuguucgugugugugucguugcaggccuuauucaagcuuaccaugagagcccuaugggugcucgggcucugcugcguacuacucacguucggaucaguccgagcagacgacgaggucgacgucgacggaacggucgaagaagaccuaggaaaaagccgcgaaggcagccggacagacgacgaggucguccagcgagaggaagaggcaauacaacucgacggucuaaacgccagccagauacgcgagcuccgggagaaaagugaaaaauucgccuuccaagcagaggucaacagaaugaugaaacucauaauuaacucccuauacaaaaacaaagaaauauuccugcgggaacuaaucuccaacgccagcgacgccuuagacaaaauacgacucaucagccugacagacgaaaacgccuugagcgggaacgaggaacuaaccgugaaaauaaaaugcgacaaagagaagaaccugcuacacguaacggauacgggaguaggcaugacacgagaagaacucgucaaaaaccucggaaccauagccaagagcggcacaagcgaguuccucaacaaaaugacagaagcccaggaggacggccaaucaacgagugagcuuauaggccaauucgggguaggguucuacagcgcguuccuaguagcggacaaaguaauagucacaagcaaacacaauaacgauacacagcacauaugggaaucagacagcaacgaauuuagcgugaucgcggacccgcggggaaacacgcuuggcagaggaaccaccaucacucuaguacucaaggaagaggcuucagacuaucuagaacuggacacaaucaaaaaccucguaaagaaauacagccaauucauaaacuucccgauauacgucuggagcucgaaaacagaaacaguagaggagccgauggaggaggaagaggcagccaaagaagaaaaagaagaaucggacgacgaagcggcagucgaagaagaagaggaagagaaaaagcccaaaaccaagaaaguagagaaaaccguaugggacugggaacucaugaacgacauaaaacccauauggcagcgcccgagcaaagaagucgaggaagacgaauacaaagccuucuacaagagcuucagcaaagaaagcgacgacccgauggccuauauacacuucacagccgaaggagaggugacguucaaaagcauccucuucgucccgacgagcgcccccaggggacucuucgacgaauacgggaguaagaaaagcgacuacaucaaacuauacguccgacggguguucauaaccgacgacuuccacgacaugaugcccaaguaccugaacuucgucaaaggagugguagauucagaugaccugccacucaacguaagcagagagacgcuccaacagcacaaacugcucaagguaauacgcaagaagcuagucaggaaaacgcucgacaugaucaaaaagauugcggacgauaaguacaacgacacguucuggaaggaguucggaacgaacauaaaacuaggcguaaucgaagaccacagcaaccgaacaagacucgcaaaacuccucagauuccagagcagccaucaccccacagacauaacaagccuggaccaauauguggaacgaaugaaagaaaaacaggacaaaaucuacuucauggcgggauccagccgcaaagaggcagaaagcagccccuucguagaacgacuccuaaagaaaggcuacgaagucaucuacuugaccgaaccaguagacgaauacugcauccaggcccuucccgaguucgacggcaagagauuccaaaacgucgcgaaggaaggcguaaaauucgacgaaagcgagaagacgaaagaaucgagggaagcagucgagaaagaguucgaaccacugcucaacuggaugaaagacaaagcgcuaaaagacaagauagaaaaagcgguaguaucgcaacggcugaccgaaagcccaugcgcccuagucgcgagccaauacggcuggagcgggaacauggaaagaauuaugaaagcgcaagccuaccagacaggaaaggacaucagcaccaacuacuacgccagccaaaagaagacguucgaaaucaacccaagacacccgcuaauaagagacaugcuacgaaggaucaaggaagacgaggacgacaagaccgugcucgaccucgcggucgugcuauucgaaacggccacgcuuagaagcggauaccugcuacccgacacgaaagccuacggcgaccgaaucgaacgcaugcuaaggcucagucuaaacauagaccccgacgcgaaaguggaagaggaaccagaggaggaaccagaagaaacggcagaggacaccaccgaggacacagaacaggacgaggacgaggagauggacgucggaacggacgaagaggaagaaaccgcaaaggaaucgaccgcagaaaaggacgagcuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4797 - RNA, 2462 nt, Artificial Sequence
  mRNA product Design3 comprising derived and/or modified sequence from Homo sapiens__NP_057376.2__HsTRAP1 (opt11)
gggagagucccgcagucggcguccagcggcucugcuuguucgugugugugucguugcaggccuuauucaagcuuaccauggcccgcgaauuacgagcccuacuacuauggggucgccgacuccgcccacuacuccgagcccccgcacucgccgcagucccuggaggaaaacccauacucugcccccgaagaacaacagcucaacucggcccccgucgcaacccagccuggucgcuccaggccggccgacucuucuccacacaaaccgccgaagacaaagaagaaccccuccacagcauaaucagcagcaccgaguccguacaaggaagcaccuccaaacacgaguuccaggccgaaaccaagaaacuucucgacaucguagcccgaagucuauacuccgaaaaagaagucuucauccgagaacuuaucucuaacgcauccgacgcacucgaaaaacuacgacacaaacucguaucagacggucaagcacuacccgaaauggaaauacaucuacaaaccaacgcagaaaaagguaccauaacaauucaagacacgggaauaggaaugacgcaggaggaacucgucucaaaccuaggcacuauagcccgaagcggcagcaaagccuuccucgacgcccuccaaaaccaagccgaagccuccuccaaaaucaucggucaguucggcguaggcuucuauuccgccuucaugguagcagaccgagucgaaguauauucucgcucagcagcccccggcucccuaggcuaccaauggcuauccgacggcagcggcguguucgaaauagcagaagccucgggcguccguacaggcaccaaaaucaucauacaccuaaaaagcgacugcaaagaauuuagcucagaagcccgcguccgagacgucgucaccaaauauucaaauuucgucucauuuccacucuaucuaaacggcagacgcaugaacacgcuccaagccaucuggaugauggacccaaaagacguccgcgaauggcagcaugaagaguucuaccgcuacguagcacaagcgcacgacaaaccacgcuacacccuccacuacaaaacggacgccccacuaaacauccgcuccaucuucuacguaccggacaugaaacccagcauguucgacguaucccgcgaacucggcucaucgguagcacucuacucuaggaaaguccucauacaaacaaaagccaccgacauccuaccaaaauggcuucgauucaucagaggcgucgucgacagugaagacaucccccucaaccucucacgagaacuccuacaagaauccgccuuaauccgaaaacuccgcgacguacuucaacagcgucucauaaaauucuucaucgaucaauccaagaaagaugcagaaaaauacgccaaauucuucgaagacuacggccucuucaugcgggaaggcaucguaacagcaaccgagcaagaggucaaagaggacauagcaaaacuccucagauacgaguccagcgcccuucccucgggccaacuaacuagccuaagcgaauacgccucacguaugagagcaggcacccgcaacaucuacuaccucugcgccccaaaccgacaccucgcagaacacucacccuacuacgaggccaugaaaaagaaagacaccgaaguccuguucugcuuugaacaauucgacgaacugacccuacuacaccucagagaguucgacaaaaagaaacucaucagcgucgagacggacaucgucguagaccacuacaaagaagaaaaauucgaggaccgcagcccagccgcagaaugccuaucggaaaaagaaaccgaagaacucauggccuggaugcggaacguccuaggcuccagaguaaccaacguaaaagucacacucagacuagacacccaccccgccauggucaccguacuagaaaugggagcugcccgacacuuccuacgaaugcaacaacuagcaaaaacacaggaggaacgcgcccaacuccuucaaccaacccucgaaauaaacccccgacacgcccuaauaaagaaacuaaaucaacugagggccuccgagcccggacucgcccaacuucuagucgaccagaucuacgaaaacgccaugaucgcggcaggccuaguagacgacccccgcgccauggugggacgacuaaaugaacuacuugucaaagcacuagagcgacauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4798 - RNA, 809 nt, Artificial Sequence
  mRNA product Design3 comprising derived and/or modified sequence from Homo sapiens__NP_000609.1__HsIGF1 (opt11)
gggagagucccgcagucggcguccagcggcucugcuuguucgugugugugucguugcaggccuuauucaagcuuaccaugggcaaaaucuccucccuccccacccaacucuucaaaugcugcuucugcgacuuccuaaaagucaaaaugcacaccauguccuccucccaccucuucuaccuagcccucugccuccuuaccuucaccuccuccgccaccgccggccccgaaacccucugcggcgccgaacucgucgacgcccuccaauuugucugcggcgaccgcggauucuacuucaacaaacccaccggcuacggcuccuccucccgccgcgcaccccaaaccggcaucgucgacgaaugcugcuuccgcuccugcgaccuccgccgccucgaaauguacugcgcaccccucaaacccgccaaauccgcccgcuccguccgcgcccaacgccacaccgacaugcccaaaacccaaaaagaaguccaccucaaaaacgccucccgcggcuccgccggcaacaaaaacuaccgcauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4799 - RNA, 890 nt, Artificial Sequence
  mRNA product Design3 comprising derived and/or modified sequence from Homo sapiens__NP_000603.1__HsIGF2 (opt11)
gggagagucccgcagucggcguccagcggcucugcuuguucgugugugugucguugcaggccuuauucaagcuuaccaugggcauccccaugggcaaauccaugcucguccuccuaaccuuccucgccuucgccuccugcugcaucgccgccuaccgacccuccgaaacacucugcggcggcgaacucgucgacacccuccaauucgucugcggcgaccgcggcuucuacuucucccgccccgccucccgcgucucacgccgcucccgcggcaucgucgaagaaugcugcuuccgcucuugcgaccucgcccuccucgaaaccuacugcgccacccccgcaaaauccgaacgcgacgucuccaccccccccacaguacuccccgacaacuucccccguuaccccgucggcaaauucuuccaauacgacaccuggaaacaauccacccaacgccuccgccgcggacuacccgcccuacuccgcgcccgccgcggccacguccuagcaaaagaacucgaagccuuccgagaagccaaacgccaccgcccccucaucgcccuccccacccaagaccccgcccacggaggcgccccccccgaaauggccuccaaccgcaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4800 - RNA, 986 nt, Artificial Sequence
  mRNA product Design3 comprising derived and/or modified sequence from Homo sapiens__NP_000591.1__HsIL6 (opt11)
gggagagucccgcagucggcguccagcggcucugcuuguucgugugugugucguugcaggccuuauucaagcuuaccaugaacuccuucuccaccuccgccuucggccccgucgccuucucccucggccuccuacucguacuccccgccgccuucccagcccccguccccccaggcgaagacuccaaagacgucgccgccccccaccgccaaccucucaccucauccgaacgcaucgacaaacaaauacgcuacauccucgacggcaucuccgcccuccgcaaagaaaccugcaacaaaucaaacaugugcgaauccucaaaagaagcccucgccgaaaacaaccuaaaccuccccaaaauggccgaaaaagacggcugcuuccaauccggcuucaacgaagaaacaugccucgucaaaauaaucaccggacuccucgaauucgaagucuaccucgaauaccuacaaaaccgcuucgaaucauccgaagaacaagcccgcgccguccaaaugucaaccaaaguccucauccaauuccuccaaaaaaaagccaaaaaccucgacgccaucacaacccccgaccccaccaccaacgccucccuacucaccaaacuccaagcccaaaaccaauggcuccaagacaugaccacccaccucauccuccgcuccuucaaagaauuccuccaauccucccuccgcgcccuccgacaaauguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4801 - RNA, 1628 nt, Artificial Sequence
  mRNA product Design3 comprising derived and/or modified sequence from Homo sapiens__NP_002183.1__HsINHBA (opt11)
gggagagucccgcagucggcguccagcggcucugcuuguucgugugugugucguugcaggccuuauucaagcuuaccaugccacuccuguggcuccgcggauuccuccuagcaagcugcuggauaauaguacgaagcuccccaacaccaggcagcgagggccacagcgccgcacccgacugcccauccugcgcacucgccgcccucccaaaagacgucccgaacagccaacccgaaauggucgaagcggucaagaaacacauacucaacaugcuacaccuaaagaaacgcccagacguaacacagccaguccccaaagccgcacuacuaaacgcgauccgaaaacuacacguaggcaaagugggagaaaauggcuacgucgaaaucgaagacgacauaggcagacgagcagaaaugaacgaacuaauggaacaaacaagugaaauaaucacauucgccgagagcggcacagcccggaaaacccuacacuucgaaaucucaaaagaaggauccgaccucagcgucguagaacgagccgaaguguggcuauuccucaaaguccccaaagccaacagaaccagaaccaaagucacaaucagacucuuccaacagcaaaaacacccgcaaggaagccucgacacaggcgaagaagcagaggaagucggacucaaaggugaacgcagcgaacuccuccuguccgaaaaagucgucgacgcccgaaaaagcacauggcacguauucccaguaagcagcuccauccaacgccugcuagaccaagggaaaucaagccuggacguccgcauagcaugcgaacaaugccaagaaagcggcgcaagccuaguacuacuagggaaaaagaaaaagaaagaggaagaaggagaaggaaagaagaaaggaggcggagaagguggagcaggcgccgacgaagaaaaagaacaaagccaccggccauuccucaugcuacaagccagacaaagcgaagaccacccacaccgacgacgccgacgaggccucgaaugcgacggaaaagucaauauaugcugcaagaaacaauucuucgucagcuucaaagacauaggguggaacgacuggaucauagccccaagcggcuaccacgccaacuacugcgaaggagaaugcccaagccacaucgccggaacauccgggagcagccugagcuuccacagcacgguaauaaaccacuaccgcaugcgcggccacagcccauucgccaaccucaaaagcugcugcguacccaccaaacuacgcccaauguccaugcucuacuacgacgacgggcagaacaucauaaagaaagacauacagaacaugaucgucgaagagugcggcugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4802 - RNA, 1571 nt, Artificial Sequence
  mRNA product Design3 comprising derived and/or modified sequence from Homo sapiens__NP_002184.2__HsINHBB (opt11)
gggagagucccgcagucggcguccagcggcucugcuuguucgugugugugucguugcaggccuuauucaagcuuaccauggacggccuaccaggacgagcccucggcgccgcaugccuccuucuccucgccgccggaugguuaggccccgaagcauggggcucacccaccccaccacccaccccagccgcacccccacccccacccccaccaggauccccaggaggcagccaagacacaugcaccucgugcggaggcuucagacgcccugaagaacuaggccgagucgacggcgacuuccucgaagccgugaaacgccauauacucucccgacuccaaaugcgcggccgacccaacauaacccacgccguacccaaagcagcuaugguaaccgcccuccgcaaacuccaugccggcaaaguccgagaagacggccgagucgaaaucccccaccucgacggacacgccucccccggcgccgacggccaagaacgaguaucagaaaucaucuccuucgcugaaaccgacggccuggcauccucccgaguccgccucuacuucuuuauauccaacgaagguaaccaaaaccucuucgucguccaagccucacuauggcucuaccuaaaacuacuccccuacguacucgaaaaaggcagccgccgcaaaguccgcguaaaagucuauuuccaagaacaaggccacggcgaccgcuggaacaugguagaaaaacgugucgaccucaaaagaucaggcuggcacaccuucccccuaaccgaagcuauccaagcacucuucgaacgaggagaacgaagacucaaccucgacguacaaugcgacucuugccaagaacucgcgguagucccaguauucgucgaccccggcgaagaaucccacagacccuuuguaguaguacaagcgcgacucggcgacucucgacaccgaauccgcaaacgcggccuagaaugcgacggacgcacaaaccucugcugccgccaacaauucuucauagacuuccgccuaaucggcuggaacgacuggaucauagcccccaccggcuacuacggcaauuacugcgaaggcucaugccccgcauaccucgccggcguccccggcucagcauccucuuuccacaccgccgucguaaaccaauacaggaugcgcggacuuaacccaggaacagucaauuccugcugcauacccaccaaacucagcaccauguccaugcucuacuucgacgacgaauacaacaucgucaaacgcgacguccccaacaugaucgucgaagaaugcggaugcgcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4803 - RNA, 3806 nt, Artificial Sequence
  mRNA product Design3 comprising derived and/or modified sequence from Homo sapiens__NP_000623.2__HsITGAM (opt11)
gggagagucccgcagucggcguccagcggcucugcuuguucgugugugugucguugcaggccuuauucaagcuuaccauggcccuccguguuuuacugcucacagcacucacacugugucacggauucaaccuagacaccgaaaaugcaaugaccuuccaagaaaacgcacgcggcuucggacaaucgguaguccaacuacaagguucgcgcguagucgucggcgccccucaagagauagucgcugcaaaccaacgaggcucacucuaccaaugcgacuacucaaccgggucaugcgaaccaaucagacuccaagucccagucgaagcagucaacaugagccugggucucagccucgccgccacaaccucacccccacaacucuuagcaugcggaccaaccguccaucagaccugcucggaaaacaccuacguaaaaggccuaugcuuucucuuuggguccaaccuacgacagcagccccaaaaauuccccgaagcccuccgaggauguccgcaagaagacagcgacauagccuuucucauugacggcuccggauccauaauaccacacgacuuccgccggaugaaggaauuugucucaacaguuauggaacaacucaagaaauccaaaacacucuucucccugaugcaauacagcgaggaguucagaauccacuucaccuucaaagaguuccagaacaaccccaacccccgcucacugguaaaaccaauaacucaacuccucggcaggacacacacggccacgggcaucaggaaggucgugcgcgaacucuucaacauaacaaauggugcacgcaaaaacgccuucaaaauccuuguggucauaaccgacggcgaaaaauucggggacccauuaggauacgaagacguaauccccgaagcggacagagagggaguaauccgauacgucaucggcguuggggacgccuuccguagcgaaaaaucccgccaggaacucaacacaauugccuccaaaccgccccgagaccacgucuuccaagucaacaacuucgaagcccucaaaaccauccaaaaccaacuccgagagaaaauauucgccauagaaggaacccaaaccggcagcuccagcuccuucgaacaugaaaugucccaagaaggcuucagcgccgcgaucaccuccaacggcccucuacucucuaccgucggaucauacgacugggcuggcggcgucuuccuuuacaccuccaaggaaaaaucgacauucaucaacaugaccagagucgauucugacaugaacgacgcauaucucggcuacgccgcugcuaucauucuacgcaacagagugcaaucucuaguauuaggagccccucguuaccaacacaucggccuaguggcaauguuccgucaaaacaccgggaugugggaaagcaacgcgaacgucaagggcacccaaaucggcgcauacuucggagcuucucucugcucuguggacgucgacucaaacggaagcacugaucucguucuuaucggagcaccccacuacuaugagcagacucgaggaggccaaguaucagucuguccacucccccguggccgagcccgcuggcaaugcgacgcgguucuauauggcgaacaaggucaacccuggggcagguucggugccgcgcucaccguccuuggagacgucaacggcgacaaacucaccgacguagcaaucggcgcaccuggcgaggaagacaaccgcggcgcaguguaccucuuccacggcaccuccggcagcggcaucucacccucccacucacaacgcauagccggcucuaaacugucccccagacugcaauacuucgggcaaagccuauccgguggacaagaccucacgauggacggccuaguagaucugacgguuggcgcgcaagggcauguacuucuacuacgaucccaaccaguacuacgugucaaggcaaucauggaguucaauccacgggaagucgcacgaaacgucuucgaaugcaacgaccaaguugucaagggcaaagaagccggcgaagucagagugugucugcacguacaaaagagcacacgugaucgacugcgagaaggacaaauccaguccguggucaccuacgaccuagcccuagacuccggaagaccccacagccgugccgucuucaacgaaaccaaaaauucaacccgccggcaaacccaggugcuaggccuuacccaaacuugcgagacgcucaaacuacaacugcccaacuguaucgaagacccagucucaccaaucguacuacgccuuaauuuuucccuagucggcacaccccucucagcauucggaaaccuccgacccguccucgccgaagacgcccaacgacuuuucaccgcccuauuccccuucgaaaagaacugcggcaacgacaacauaugucaagacgaccucagcaucaccuucucuuucaugucgcucgacugccuagugguaggcggaccccgagaauuuaacgucacagucaccguaagaaacgacggagaggauuccuacagaacgcaaguuacauucuucuucccgcucgaccucucguaccgcaaagucucgacccuucaaaaccaacgaucucaacgaucuuggaggcucgcaugugaaucagccucgucaacagaaguaaguggcgcccucaaaucgaccuccuguuccauaaaccacccaaucuuccccgagaacagcgaagucacauucaacauaacauucgacguugacucuaaagcaucacucggcaacaaacucuuacugaaagccaacgucaccagcgaaaacaacaugccaagaacaaacaaaacagaguuccaacucgaacucccagucaaguaugccguauacauggucgucaccagccacggaguauccacaaaauaccucaacuuuaccgccagcgaaaacacguccagaguaaugcaacaccaauaccagguauccaaccuuggucaacgcagucuacccaucucccuaguguuccucguucccgucagacuaaaccagacaguaauaugggaccguccacaaguaacauucucugaaaaccucuccuccacaugucacacuaaagaacgacucccuagccauuccgacuuucuugcagagcuucgcaaagccccuguugugaacugcucaaucgcgguaugccagcgcauacagugcgacauaccauucuuugggauacaggaagaguucaacgcgacucucaaagguaaccucagcuucgacugguauaucaagaccucacauaaccaccuccuaauaguauccacagccgaaauccucuucaacgacagcgucuucacauugcugcccggccaaggagcuuucguacgaucgcagacagaaacuaaaguagaaccuuucgaagucccgaacccgcucccgcuaaucgucggauccuccguuggcgggcuacuccuucuugcccucaucacagcagcacuguauaagcucggcuucuucaagcgccaauacaaagauaugauguccgaaggcggcccgcccggggccgaaccccaguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4804 - RNA, 1751 nt, Artificial Sequence
  mRNA product Design3 comprising derived and/or modified sequence from Homo sapiens__NP_002415.1__HsMMP8 (opt11)
gggagagucccgcagucggcguccagcggcucugcuuguucgugugugugucguugcaggccuuauucaagcuuaccauguucucccucaaaaccuuaccguuccuccuacuacuacacguccaaaucuccaaagccuucccugucuccagcaaagagaaaaacacuaaaaccguacaggacuaccucgaaaaauucuaccaacuacccucaaaccaguaccaguccacccgcaaaaacggcacaaacgugaucgucgaaaagcuaaaagaaaugcaacgcuucuucggccuaaacgucacaggcaaacccaacgaagaaacccucgacaugaugaagaaaccccgaugcggcguccccgacuccggcggcuucaugcucacacccgguaaccccaaaugggaacgaaccaaccuaaccuaccgcauacgaaacuacacaccccaacucucagaagccgaagucgaacgagcuaucaaagacgcauuugaacucugguccgucgcaucaccccucaucuucacccgcaucucucaaggcgaagccgacauaaauaucgccuucuaucaaagagaccacggcgacaacucccccuucgacggcccgaacgguauccucgcacacgccuuccaaccaggccaaggaaucggcggcgaugcccacuucgacgcagaagaaaccuggacaaacaccucagccaacuacaaccucuuccucgucgccgcgcacgaguucggacauucccucggccuagcccacuccuccgaccccggugcacucauguacccaaacuacgccuuccgcgaaaccagcaacuacucacucccccaagacgacauagacggcauccaagccauauacggacuaucauccaaccccauccagccaaccggacccucaacccccaaacccugcgauccaucccucaccuucgacgccaucaccacccuacguggagagauccucuucuucaaagaucgauauuucuggcgccgacacccccaacugcaacggguugaaaugaacuucaucagccucuucuggccuucacuacccaccggaauccaagccgccuaugaagacuuugaccgcgaccucaucuuccucuucaaaggaaaccaauacugggcccucucggguuacgacauccuucaaggcuacccuaaagacauaucaaacuacggauucccaucguccguccaagccaucgaugccgcaguuuucuaccgcuccaaaaccuacuucuucgucaacgaccaauucuggcgcuaugacaaccaacgccaauucauggaaccaggauaccccaaauccaucuccggcgccuuccccggcaucgaaagcaaagucgacgcagucuuccaacaagaacacuucuuccacguuuucucaggcccucgcuacuacgccuucgaccuaaucgcccaacgagucacccgagucgcccgaggaaacaaauggcuuaacugccgcuacggauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4805 - RNA, 2471 nt, Artificial Sequence
  mRNA product Design3 comprising derived and/or modified sequence from Homo sapiens__NP_004985.2__HsMMP9 (opt11)
gggagagucccgcagucggcguccagcggcucugcuuguucgugugugugucguugcaggccuuauucaagcuuaccaugucccucuggcaaccucucguauuaguacuccuaguccuuggaugcugcuuugccgcuccucgacaacgccaauccacacucguccuuuucccaggggaucuaagaaccaaccuuaccgaccggcaacuagcagaggaauaccuauaccgcuauggauacacaagagucgccgaaaugagaggagaaucgaaaagccucggaccagcccuccuacuacuacaaaaacaacucucccugcccgaaacuggcgaacucgacucugccacucuaaaagcaaugaggaccccacgaugcggcguccccgaccuaggcagauuccaaaccuucgaaggcgaucuaaaauggcaccaccacaacauaaccuacuggauccaaaacuacucagaagaccucccccgagccguaauagacgaugccuucgcaagagcuuucgcccucuggucggcagucacuccccucaccuuuaccagaguauacucccgagacgccgacauagucauccaauucggcgucgccgaacacggcgacggcuaccccuucgacggaaaagauggacuccucgcucacgcguucccaccaggcccagguauccaaggcgaugcucacuucgacgacgacgaacuauggucucucggaaaaggggucgucguccccacccgauucggaaacgcagacggcgccgcuugccacuuccccuucaucuucgaaggacguuccuacagcgccugcacgaccgacggaagauccgauggacuaccauggugcucaacgaccgccaacuacgacacagacgacagauucggauucugucccucagaacgucucuacacacaagacggcaacgccgauggcaaacccugccaauuccccuucauauuccaaggccaauccuacuccgccugcacaaccgacggacgcucugacggcuaccgauggugcgcuacaacagcaaacuaugaucgagacaaguuauuuggauucugccccacccgcgccgauuccaccguaaugggugggaacuccgcaggagaacucugcgucuuccccuucaccuuccucggaaaagaguacagcacaugcaccuccgaaggccgaggcgacggccgccuauggugcgccaccaccuccaacuuugacucagacaagaaaugggguuucugccccgaccaagguuacagccucuuccucgucgccgcacaugaauuuggacacgcauuaggccuagaccacucgucaguccccgaagcccucauguaccccauguacagauucacugaaggcccaccccuccacaaagacgacgucaacggaauccgccaucucuacggcccccgaccagaaccugaaccacgcccacccacaaccaccacaccccaacccaccgccccacccacugucugccccaccggcccacccaccguccaucccagcgagagacccaccgcgggcccaaccggcccacccuccgcaggccccacuggacccccaaccgcaggacccuccaccgcuacuaccguuccacuauccccagucgacgacgcuugcaacgucaacaucuucgacgccauagcugagauaggaaaccagcucuaccuauucaaagacggaaaauacuggcgauucuccgagggacgcggcucccgcccccaaggaccauuucuaauagcagacaaguggcccgcacucccacgcaaacuugacuccguuuucgaggaaagacucuccaagaaacuauucuucuuuuccggccgacaagucuggguuuacacaggcgccuccguacucgguccucgccgccuugacaaacuagggcucggcgcagacgucgcccagguaacaggagcucuccgaagcggaaggggcaaaauguuacucuucuccggccgucgacucuggcgauucgacguaaaagcccaaaugguagaucccagaagcgccagcgaagucgaccgcauguucccaggagucccccuugauacccacgacgucuuccaauaccgcgaaaaagccuacuuuugccaagaccgcuucuacuggcgcgucucuagcagaucagaacuuaaccaaguagaccaaguaggcuacgucaccuacgacauccuacagugcccagaagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4806 - RNA, 1763 nt, Artificial Sequence
  mRNA product Design3 comprising derived and/or modified sequence from Homo sapiens__NP_002418.1__HsMMP13 (opt11)
gggagagucccgcagucggcguccagcggcucugcuuguucgugugugugucguugcaggccuuauucaagcuuaccaugcaccccggcguacucgcagccuuccuauuccuauccuggacccacugccgcgcauuaccccuccccucaggaggcgaugaagacgaccuuuccgaagaagaccugcaauucgccgaacgcuaccuccgauccuacuaccaccccaccaaccucgccggcauacucaaagaaaacgcagccucauccaugacagaacgccuccgcgaaaugcaauccuucuuuggccucgaagucaccggaaaacuugacgacaacacgcuagacgucaugaaaaaacccagaugcggaguccccgacgucggcgaauacaacgucuuccccagaacccuaaaauggucaaaaaugaaccucaccuacagaauagucaacuacaccccugacaugacccacuccgaaguagaaaaagccuucaaaaaagccuucaaagucuggucugacguuaccccccucaacuucacccgacuccacgacggcaucgccgacauaaugaucuccuucggaaucaaagaacacggcgacuucuaccccuucgacggaccaucaggccuacucgcccacgccuucccaccaggacccaacuacggaggcgacgcccacuucgaugacgacgaaaccuggaccuccuccuccaaaggcuacaaccucuuccuaguagccgcacacgaauucggccacucacuaggacuagaccacuccaaagaccccggcgcucuuauguuccccaucuacaccuacacugggaaaucccacuucaugcuccccgacgacgacguacaaggcauccaaagccucuacggcccgggcgacgaagaucccaaccccaaacaccccaaaacaccagacaaaugcgaccccucacuaucacuagacgcaaucaccucccuccguggcgaaacuaugaucuucaaagaccgauucuucuggcgcuuacacccccaacaagucgacgccgaacucuuccuuaccaaaucauucuggcccgaacuccccaaccgcaucgacgccgccuacgaacaccccagccaugaccucaucuuuaucuuccgcgggagaaaauucugggcacuaaacggauacgacauacucgaaggcuacccaaaaaaaaucuccgaacuaggccucccaaaggaagucaaaaagaucuccgcagcaguacacuucgaagacaccggcaaaacccuccuauucucagguaaccaaguauggcgcuacgacgacaccaaccacaucauggacaaagacuacccccgccucaucgaagaagacuuccccggcauaggcgacaaagucgacgccgucuaugaaaaaaacggcuacauauacuucuuuaacggccccauccaauuugaauacuccauaugguccaaccgcaucguacgcguuaugccagccaacuccauccucuggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4807 - RNA, 1415 nt, Artificial Sequence
  mRNA product Design3 comprising derived and/or modified sequence from Homo sapiens__NP_001286.1__HsCCR1 (opt11)
gggagagucccgcagucggcguccagcggcucugcuuguucgugugugugucguugcaggccuuauucaagcuuaccauggaaaccccgaacaccaccgaagauuacgacaccacaaccgaguucgacuacggcgacgccacccccugccaaaaagucaacgaacgcgccuucggcgcccaacuccucccaccccuuuacucccucgucuucgucaucggccucgucggcaauauccucguaguccucguccucguccaauacaaacgacucaaaaacaugaccuccaucuaccuacucaaccuugccaucuccgaccuccucuuccucuucacccuccccuucuggauagacuacaaacucaaagacgacugggucuucggcgacgccaugugcaaaauccucucgggcuucuacuacacaggacucuacuccgaaaucuucuucaucauccuccuaacuaucgaccgcuaccuagccaucguccacgccgucuucgcacuacgcgcccgcaccguaaccuucggcgucaucaccucaaucaucaucugggcccucgccauccucgccuccaugcccggccucuacuucucaaaaacccaaugggaguucacacaccacacaugcucacuccacuucccccacgaaucccuacgcgaauggaaacucuuccaagcccucaaacucaaccuauucggccuaguccucccacuacucgucaugaucaucugcuacacaggcaucaucaaaauacuccuccgccgccccaacgaaaagaaauccaaagcaguccgccucaucuuugucauaaugauaaucuucuuccuauucuggacccccuacaaccucaccauccucaucucaguauuccaagacuuccucuucacccaugaaugcgaacaaucacgccacuuagaccucgccguccaagucaccgaggucauugccuacacccacugcugcgucaacccaguaaucuacgccuucgucggcgaacgcuuccgcaaauaccuccgucaacuauuccaccgacgcgucgccguacaccucgucaaauggcuccccuuccuaucugucgaccgacuagaacgcgucuccuccacaagcccaagcaccggcgaacacgaacucuccgccggcuucuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4808 - RNA, 983 nt, Artificial Sequence
  mRNA product Design3 comprising derived and/or modified sequence from Homo sapiens__NP_002598.4__HsPDGFA (opt11)
gggagagucccgcagucggcguccagcggcucugcuuguucgugugugugucguugcaggccuuauucaagcuuaccaugcgcacacucgccugccuccuacuccucggcugcggcuaccucgcacacguccucgccgaagaagccgaaaucccccgagaagucaucgaacgacucgcccgcucccaaauccacuccauccgcgaccuccaacgccuccucgaaaucgacuccgucggcuccgaagacucccucgacaccucacuccgcgcccacggaguccacgccaccaaacacguacccgaaaaacgaccccuccccauccgccgaaaacgcuccauagaagaagccguccccgccgucugcaaaacccgcaccgucaucuacgaaaucccccgcucccaagucgaccccacauccgccaacuuccucaucuggccccccugcguagaagucaaacgcugcaccggcugcugcaacacauccuccguaaaaugccaacccucccgcguacaccaccgcuccgucaaagucgccaaagucgaauacguccgcaaaaaacccaaacuaaaagaaguccagguccgccucgaagaacaccucgaaugcgccugcgccaccaccucccucaacccagacuaccgcgaagaagacaccggccgcccccgcgaauccggcaaaaaacgcaaacgcaaacgccugaaacccaccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4809 - RNA, 1073 nt, Artificial Sequence
  mRNA product Design3 comprising derived and/or modified sequence from Homo sapiens__NP_002599.1__HsPDGFB (opt11)
gggagagucccgcagucggcguccagcggcucugcuuguucgugugugugucguugcaggccuuauucaagcuuaccaugaaccgaugcugggcccucuuccucagccucugcugcuaccuacgacuuguaucagccgaaggcgacccaaucccagaagaacuauacgaaaugcuguccgaccacuccauccgcuccuucgacgaccuccaacgccuccuccacggugaccccggcgaagaagacggcgccgaacuagaccuuaauaugacccgcucccacuccggcggagaacucgaaucacucgcccgcggacgccgcucccuaggcucccucaccaucgccgaaccagccaugaucgccgaaugcaaaacacgcaccgaaguauucgaaaucucacgccgacucaucgaccgcaccaacgccaacuuccuugucuggcccccaugcgucgaaguccaacgcugcuccggcugcugcaacaaccgcaacguacaaugccgacccacacaaguacaacuccgcccaguccaaguacgcaaaaucgaaaucguccgcaaaaaaccaaucuucaaaaaagccacagucacccucgaagaccaccucgccugcaaaugcgaaaccguagccgccgcacgccccgucacccgcucacccggcggaucacaagaacaacgugcaaaaaccccccaaacccgcgucacaauccgcaccguccgcguccgccgcccccccaaaggaaaacaccgcaaauucaaacacacacacgacaaaaccgcccucaaagaaacccuaggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4810 - RNA, 1385 nt, Artificial Sequence
  mRNA product Design3 comprising derived and/or modified sequence from Homo sapiens__NP_057289.1__HsPDGFC (opt11)
gggagagucccgcagucggcguccagcggcucugcuuguucgugugugugucguugcaggccuuauucaagcuuaccaugagccucuucggccuccuccuccucaccuccgcccuggccggccagcgccaaggcacccaggccgaauccaaccucuccuccaaauuccaauucuccuccaacaaagaacaaaacggcguccaagacccccaacacgaacgaaucaucaccgucucaacaaacggcucaauacacucaccacgcuucccccacaccuacccaagaaacaccguccucgucuggcgccuagucgccgucgaagaaaacguauggauccaacucaccuucgacgaacgcuucggccucgaagacccagaagacgacaucugcaaauacgacuucguagaagucgaagaaccuagcgacggcaccauacucggacguuggugcggcuccggcaccguccccggcaaacaaaucuccaaaggcaaccaaauccgaauacgcuucguauccgacgaauacuucccauccgaacccggcuucugcauccacuacaacaucgucaugccccaauucaccgaagccgucucccccuccguacuaccccccuccgcccucccccucgaucuucucaacaacgccaucacggccuucuccacccucgaagaccuaauacgcuaccuggaacccgaaagauggcaacucgaucucgaagaucuauaccgccccacauggcaacuccucggcaaagccuucgucuucggcagaaaaucccgggucguagaccucaaccuccucaccgaagaaguacgccuauacuccugcacaccacgcaacuucuccguauccauccgagaagaacucaaacgcaccgacacuaucuucuggcccggcugccuccucgucaaaagaugcggcggaaacugcgccugcugucuccacaacugcaacgaaugccaaugcguccccuccaaaguaaccaaaaaauaccacgaaguccuacaacuucgcccaaaaaccggcguaagaggccuccacaaaucccucaccgacgucgcacuagaacaccacgaagaaugcgacugcgucugccgcggcuccaccggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4811 - RNA, 1442 nt, Artificial Sequence
  mRNA product Design3 comprising derived and/or modified sequence from Homo sapiens__NP_149126.1__HsPDGFD (opt11)
gggagagucccgcagucggcguccagcggcucugcuuguucgugugugugucguugcaggccuuauucaagcuuaccaugcaccgccuaaucuucgucuacacccuaaucugcgccaacuucugcuccugccgagacaccuccgccaccccacaauccgccuccauaaaagcacuccggaaugccaacuuacgccgggacgaccuauaccgucgagacgaaacaauccaaguaaaaggaaacggcuacgugcaaucgccccgauucccaaacuccuacccacgcaaccuccuccucaccuggcgacuacacucccaagaaaacacucgcauccaacucgucuucgacaaccaguucggccuggaagaagccgaaaacgacaucugccgcuacgacuucgucgaagucgaagacauaucagaaaccuccaccaucauacgcggccgcuggugcggccacaaagagguacccccccgcaucaaaucccgcacaaaccaaaucaaaauaaccuucaaaucagacgacuacuucguagcuaaacccggauucaaaaucuacuacucccuccuagaagacuuccaacccgccgcagcauccgagaccaacugggaauccguaaccuccuccauauccggcguauccuacaacagccccuccgucacagaccccacccuuauagccgacgcccucgacaaaaaaaucgccgaauucgacaccgucgaagaucuccuaaaauacuucaaccccgaaucauggcaagaagaccucgaaaacauguaccuagacaccccacgauaccgcggacgcucauaccacgaccgaaaauccaaagucgaccucgaccgacucaacgacgacgccaaacgcuacagcugcacaccacgcaacuacuccgucaacauccgcgaagagcuaaaacucgccaacguagucuucuucccccgcugccuucucguccaaagaugcggcggcaacugcggcuguggaaccguaaacuggcgcagcugcaccugcaacucaggcaaaaccgucaaaaaauaccacgaaguccuccaauucgaaccaggccacaucaaacgccgcggccgagccaaaacaauggcccucgucgacauccagcucgaccaccacgaacgcugcgacugcauaugcuccagccgccccccucgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4812 - RNA, 1025 nt, Artificial Sequence
  mRNA product Design3 comprising derived and/or modified sequence from Homo sapiens__NP_003946.3__HsSOCS3 (opt11)
gggagagucccgcagucggcguccagcggcucugcuuguucgugugugugucguugcaggccuuauucaagcuuaccauggucacccacuccaaauucccugccgcaggcaugucccgaccccucgacaccucccuccgacucaaaaccuucuccucaaaguccgaauaccaacucgucgucaacgccguccguaaacuccaagaauccggcuucuacugguccgccgucaccgguggugaagcaaaccuccuccucuccgcagaacccgccggcaccuuccucauccgcgacuccucagaccaacgccacuucuucacccucucagucaaaacccaauccggcaccaaaaaccuccgcauccaaugcgaaggcggcuccuucucccuccaauccgacccacgcuccacacaaccugucccacgcuucgacugcguccucaaacucguccaccacuacaugccaccccccggcgcccccuccuucccauccccccccaccgaacccuccucagaaguccccgaacaacccucagcccaaccccuccccggcucccccccccgccgcgcauacuacaucuacuccggcggcgaaaaaaucccacucguacucucccgcccccucuccuccaacgucgccacccuacaacaccucugccgcaaaaccgucaacggccaccucgacuccuacgaaaaagucacccaacuacccggccccauccgcgaauuccucgaccaauacgaugcaccccuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4813 - RNA, 830 nt, Artificial Sequence
  mRNA product Design3 comprising derived and/or modified sequence from Homo sapiens__NP_003227.1__HsTGFA (opt11)
gggagagucccgcagucggcguccagcggcucugcuuguucgugugugugucguugcaggccuuauucaagcuuaccaugguccccuccgccggccaacucgcccuauucgcccucggaaucguccucgcagccugccaagcccucgaaaacuccaccuccccccucuccgccgacccccccgucgccgccgccgucgucucccacuucaacgacugccccgacucccacacccaauucugcuuccacggcaccugccgcuuccucguccaagaagacaaacccgccugcgucugccacuccggcuacgucggcgcccgcugcgaacacgccgaccuccucgccgucgucgccgccucccaaaaaaaacaagccaucaccgcccucgucgucgucuccaucgucgcccucgccguccucaucaucaccugcguccuaauccacugcugccaaguccgcaaacacugcgaauggugccgcgcccucaucugccgccacgaaaaacccuccgcccuccucaaaggccgcaccgccugcugccacuccgaaacagucguuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4814 - RNA, 1520 nt, Artificial Sequence
  mRNA product Design3 comprising derived and/or modified sequence from Homo sapiens__NP_000651.3__HsTGFB1 (opt11)
gggagagucccgcagucggcguccagcggcucugcuuguucgugugugugucguugcaggccuuauucaagcuuaccaugccucccucuggccuucgacugcucccccuccuccucccccuccuauggcuccuaguccuaacacccggccgcccagccgcaggccucuccacaugcaaaacaauagacauggaacucgucaaacgaaaacgcaucgaagcaauccgcggccaaauacucucuaaacuucgccucgccucaccacccucccaaggcgaagucccaccaggaccccuccccgaagccguauuagcucucuacaacuccacacgcgaccgcgucgcaggcgagagcgccgaacccgaacccgaaccugaagcugacuacuacgccaaagaaguaacacgcguccucaugguugaaacccacaacgaaaucuaugacaaauucaaacaauccacccacucaaucuacauguucuuuaacacaucagaacuccgcgaagccguccccgaaccaguccuccuuucccgugccgaacuccgccuacugcgccucaaacuaaaaguagaacaacacguugaacucuaccaaaaauacucaaacaauuccuggcgauaccucuccaaccgccuccucgcccccuccgacagccccgaauggcucucuuuugacgucacaggcgucguacgccaauggcucucaagaggcggcgaaaucgaaggcuuccgccucucagcccauugcucuugcgacucucgcgacaacacccuccaagucgacaucaacggcuucaccaccggccgacgcggcgaccucgccaccauccacggcaugaaccguccuuuccuacuucuaauggccacaccccucgaacgcgcccaacaccuccaaucaucacgccacagacgcgcccucgacaccaacuacugcuucuccuccaccgaaaagaacugcugcguacgccaacucuacaucgacuuccguaaagaccucggcuggaaauggauccacgaacccaaaggcuaccacgccaacuucugucuuggcccaugccccuacaucuggucccuagacacucaauacuccaaaguccuagcccuuuacaaccaacacaaccccggcgcaucagccgcccccugcugcguaccccaagcccucgaaccacuccccauagucuacuacguaggccgaaaacccaaagucgagcaacuauccaacaugaucguccggucgugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4815 - RNA, 1592 nt, Artificial Sequence
  mRNA product Design3 comprising derived and/or modified sequence from Homo sapiens__NP_003229.1__HsTGFB2 (opt11)
gggagagucccgcagucggcguccagcggcucugcuuguucgugugugugucguugcaggccuuauucaagcuuaccaugcacuacugcguccucuccgccuuccucauauuacaccucgucaccguugcccuaucccucucgacuugcuccacccucgacauggaccaauucaugcgcaaaagaaucgaagcaauccgaggccaaauccucucaaaacucaaacuuacaucccccccugaagacuauccagaacccgaggaaguccccccugaagucauauccauauacaacagcacccgcgaccuacuccaagaaaaagccucgcgacgagccgcagccugcgaacgcgaacgcagcgacgaagaauacuacgccaaggaagucuacaaaaucgacaugccgcccuucuucccaucagagaaugcuaucccccccaccuucuaccgaccauacuuccgcaucguccgcuucgacgucuccgcaauggaaaaaaacgccuccaaccucgucaaagccgaauuccgcgucuuccgccugcaaaaccccaaagcccgcguucccgaacaacgcaucgaacucuaccaaauacucaaauccaaagaccucaccucucccacccaacguuacaucgacucuaaaguagucaaaacacgcgccgaaggcgaauggcucuccuucgacguaaccgacgccguacacgaauggcuccaccacaaagacagaaaccucggauucaaaaucucccuacacugccccugcugcacuuucguccccuccaacaacuacauaauucccaacaaauccgaagagcuugaagcccgcuucgccggcaucgacggaaccucgaccuacacuucaggcgaccagaaaaccauuaaauccacccgcaaaaaaaacucgggcaaaacaccccaccuccuacucaugcuccucccauccuaccggcuagaaucccaacaaaccaaccgacgcaaaaaacgagcccucgacgcagccuacugcuuccguaacguccaagacaauugcugccuacgcccacucuacaucgauuucaaacgugaccucggauggaaauggauccaugaacccaaaggcuacaacgccaacuucugcgcaggcgcaugccccuaccucuggagcuccgacacccaacacucccgcguccuaagccuuuacaacaccaucaaccccgaagccucagccucccccugcugcgucucccaagaccucgaaccacuaacaauccucuacuacaucggcaaaacccccaaaauagaacaacucuccaacaugaucgucaaauccugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4816 - RNA, 1586 nt, Artificial Sequence
  mRNA product Design3 comprising derived and/or modified sequence from Homo sapiens__NP_003230.1__HsTGFB3 (opt11)
gggagagucccgcagucggcguccagcggcucugcuuguucgugugugugucguugcaggccuuauucaagcuuaccaugaaaaugcaccuccaacgagcccuagucguccucgcacuacucaacuucgcaaccgucucccuaagccuuuccacaugcaccacccuggacuucggccacaucaaaaagaaacgugucgaagccauucgaggccaaauacucagcaaacuccgccucacaucacccccagaacccacaguuaugacccacguccccuaccagguccuagcccuauacaacagcacccgcgaacuccucgaagaaaugcacggcgaacgcgaagaaggcugcacccaagaaaauacagaguccgaauauuaugcaaaagaaauccacaaauucgacaugauccagggccucgccgaacacaacgagcucgccgucugucccaaaggcaucaccuccaaaguauucagauucaacgugucauccgucgagaaaaaccgcaccaaccucuuccgcgccgaguuccguguccuccgcgucccaaaccccuccagcaaacgaaacgaacaacgaauagaacuauuccagauccuccgccccgacgaacacaucgccaaacaacgcuacauugggggcaaaaaccuccccacccgcggaacagccgaauggcuauccuucgacgucaccgacaccguccgcgaauggcuacuaagaagagaauccaaccucggccucgaaaucuccauacacugccccugccacaccuuccaacccaacggagacauacucgaaaacauccacgaaguaauggaaaucaaguucaaaggagucgacaacgaagacgaccacggccgcggcgaccuaggccgccucaaaaagcagaaagaccaccacaacccccaccuaauacuaaugaugauacccccucaccgccucgacaaccccggccaaggcggacaacgcaaaaagcgcgcccucgacacuaacuacugcuuccgcaaccucgaagaaaacugcugcguccgcccccucuacaucgacuuccgccaagaccucggguggaaauggguacacgaacccaaaggcuacuacgccaacuucugcagcggaccaugcccauaccucagaagcgcagacacaacacacuccaccguccucggccucuacaacacccuaaaccccgaagccucagccucccccugcugcguaccacaagaccuugaaccacucaccauccucuauuacguaggccgcacccccaaagucgaacaacucucaaacauggucguaaaaucaugcaaaugcuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4817 - RNA, 1733 nt, Artificial Sequence
  mRNA product Design3 comprising derived and/or modified sequence from Homo sapiens__NP_001057.1__HsTNFRSF1B (opt11)
gggagagucccgcagucggcguccagcggcucugcuuguucgugugugugucguugcaggccuuauucaagcuuaccauggcaccagucgcagucugggccgcccucgccguaggccuugaacucugggcagccgcccacgcccucccagcacaagucgcauucacucccuacgcacccgaacccggcuccaccugccgccuacgcgaauacuaugaccaaacagcacaaaugugcugcuccaaaugcucucccggccaacacgcuaaaguauucugcacaaaaaccucugacaccguaugcgacucaugcgaagacuccacauauacccaacucuggaacuggguccccgaaugccucuccugcggcucccgcugcagcucagaccaaguagaaacccaagcuugcacccgcgagcaaaaccgcaucugcacaugccgccccggcugguacugcgcucucuccaaacaagaaggcugcagacuuugugcaccucugaggaaaugccgaccaggcuuugguguagcaagacccgguaccgaaaccucagacgucgucugcaaaccgugugcacccggcaccuucucaaacaccaccuccucuaccgacaucugccgaccacaucaaaucugcaacguagucgccaucccaggcaacgccuccauggacgccguaugcaccucgaccucccccacccgcuccauggcccccggcgccguacaccuaccccaacccgucuccacccgaucccagcacacccaacccaccccagaacccagcaccgccccgucaaccucauuccuacucccaaugggccccuccccacccgcagaaggcuccacaggcgauuucgcccuccccguaggacuaauaguuggcgucaccgcccuaggccuccuuaucaucggcguagucaacugcgucaucaugacccaagucaaaaaaaaaccccucugccuccaacgcgaagccaaagucccacaccucccagccgacaaagcccgcggaacccaaggccccgaacaacaacaccugcucaucaccgcccccucaucaagcuccuccucacucgaaucauccgccuccgcccucgaucgacgcgcccccacacgcaaccaaccacaagccccaggcguagaagcguccggcgccggcgaagcccgcgccuccaccggcucguccgacuccucaccaggaggucacggcacccaaguaaaugucaccugcaucgugaacguuuguuccuccucagaucacagcucccaaugcucuucccaagccuccuccacaaugggcgacaccgauuccagccccucagaaucccccaaagacgaacaagucccauucucaaaagaagagugugccuuccgaucccagcucgaaacaccagaaacccuacucgguucaaccgaagaaaaaccccucccccucggcgucccagacgcaggcaugaaacccuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4818 - RNA, 860 nt, Artificial Sequence
  mRNA product Design3 comprising derived and/or modified sequence from Homo sapiens__NP_002623.2__HsPGF (opt11)
gggagagucccgcagucggcguccagcggcucugcuuguucgugugugugucguugcaggccuuauucaagcuuaccaugccggucaugcgccuguucccgugcuuucuccagcuacuggccgggcucgcgcucccggccgugcccccgcaacaaugggcgcucucggccggaaacgggagcucggaaguggaaguggucccguuccaggaagugugggggcgcucguacugucgagcgcucgagcgcuuggucgaugucgugagcgaguacccgagcgaggucgagcacauguucucgcccucgugcgugagcuugcuaaggugcacgggauguugcggggacgagaacuugcacuguguaccggucgagaccgcgaacgugaccaugcaauugcucaagaucaggagcggggacaggcccucguacguggaauugaccuuuagccagcacgugcgcugugaaugucgcccgcucagggaaaagaugaagccagagcgcaggcgcccgaaagggcgagggaaaaggcgcagggaaaagcaaagacccacggacugucacuugugcggggacgcggucccgaggcgcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4819 - RNA, 1586 nt, Artificial Sequence
  mRNA product Design3 comprising derived and/or modified sequence from Homo sapiens__NP_001020537.2__HsVEGFA (opt11)
gggagagucccgcagucggcguccagcggcucugcuuguucgugugugugucguugcaggccuuauucaagcuuaccaugaccgauagacagaccgacacagcgcccucacccucguaccaucucuugccggggaggaggagaacgguagacgcggcggcaucgcgcgggcaagggccggaaccagcgccagggggaggagucgaaggagugggagcgagaggggucgcgcuaaaacucuucguccaacugcugggaugcagcagguucgggggagcagugguaagagcaggagaggcagagccaucgggcgcggcaaggagcgcaagcucgggaagggaggaaccacagccagaagaaggggaagaggaagaggaaaaggaagaagaaaggggaccacaauggagacuaggcgcgagaaagccagggagcuggacaggggaggcggccgugugcgcggacucggcaccagccgcaagagcgccgcaggcacuagcaagggccucgggaaggggaggaaggguggcaagacgaggagccgaggaaucaggaccaccacacagcccaagcaggcgagggagcgcgagcagggcagggcccgggagagcaagcgagacaaugaacuuucucuugagcuggguacauuggucgcuagcgcuccuacuguaucugcaccacgcgaaauggagccaggcagcgccaauggcagagggaggagggcagaaccaccacgaagucgugaaauucauggauguauaccaaaggagcuacugccacccaauagaaacgcuaguagacauauuccaggaauauccagaugaaauugaauacauauucaaaccgagcugcguaccacucaugagguguggcggaugcuguaacgaugaagggcuagagugcgugccaacagaagagagcaacauaacaaugcaaauaaugcgaauaaaaccacaccaaggacagcacauaggagagaugagcuuccuacaacacaacaagugcgagugcaggccaaagaaagacagagcgcgccaagaaaagaaaagcguaaggggaaaggggaagggacagaaaaggaaaaggaaaaagaguagauacaaaaguuggagcguauacguaggagcgagaugcugcuugaugccguggucacuaccgggaccacacccgugugggcccugcagcgagagacgaaaacaccuauucgugcaggacccgcagacgugcaagugcucguguaagaacacggacucgaggugcaaagcgagacagcuagagcugaaugaaaggaccugccgaugugacaagcccagaagguagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4820 - RNA, 1046 nt, Artificial Sequence
  mRNA product Design3 comprising derived and/or modified sequence from Homo sapiens__NP_001165094.1__HsVEGFA (opt11)
gggagagucccgcagucggcguccagcggcucugcuuguucgugugugugucguugcaggccuuauucaagcuuaccaugaacuuccuccuaagcuggguccacuggucccucgcccuacuccucuaccuacaccacgccaaauggucccaagccgcacccauggccgaaggcggcggccaaaaccaccacgaagucgucaaauucauggacgucuaccaacgcucauacugccaccccaucgaaacccucgucgacaucuuccaagaauaccccgacgaaauagaauacaucuucaaacccucaugcgucccccucaugcgcugcggcggcugcugcaacgacgaaggacucgaaugcguacccaccgaagaaucaaacaucacaaugcaaaucaugcgcaucaaaccccaccaaggccaacacaucggcgaaauguccuuccuccaacacaacaaaugcgaaugccgccccaaaaaagaccgagcacgacaagaaaaaaaauccguccgaggcaaaggcaaaggccaaaaacgaaaaagaaaaaaaucccgcuacaaauccugguccguauacgucggcgcccgaugcugccucaugccauggucccuccccggcccccacccaugcggccccugcuccgaacgccgcaaacaccucuucguccaagacccccaaaccugcaaaugcuccugcaaaaacaccgacuccagaugcaaagcccgccaacucgaacucaacgaacgcaccugccgcugcgacaaaccccgacgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4821 - RNA, 971 nt, Artificial Sequence
  mRNA product Design3 comprising derived and/or modified sequence from Homo sapiens__NP_003368.1__HsVEGFB (opt11)
gggagagucccgcagucggcguccagcggcucugcuuguucgugugugugucguugcaggccuuauucaagcuuaccauguccccccuccuccgccgccuccuccucgcagcccuacuccaacuagcccccgcacaagcccccgucucccaacccgacgcccccggccaccaacgcaaaguagucuccuggauagacgucuacacccgcgccaccugccaaccccgcgaagucguagucccccucacagucgaacucaugggcacagucgccaaacaacucguacccucaugcgucaccguccaaagaugcggcggcugcugccccgacgacggccucgaaugcguccccaccggccaacaccaaguccgcaugcaaauacucaugauccgauacccaucaucccaacuaggagaaaugucacucgaagaacacucucaaugcgaaugcagacccaaaaaaaaagacucagccguaaaaccagaccgcgccgcaacaccccaccaccgcccccaaccacgaucaguccccggcugggacuccgcccccggcgcccccucccccgccgacaucacccaccccacccccgcccccggcccauccgcccacgccgcccccuccaccaccucugcccuaacccccggccccgccgccgccgccgcagacgccgccgccucauccgucgccaaaggcggcgccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4822 - RNA, 1607 nt, Artificial Sequence
  mRNA product Design3 comprising derived and/or modified sequence from Homo sapiens__NP_005420.1__HsVEGFC (opt11)
gggagagucccgcagucggcguccagcggcucugcuuguucgugugugugucguugcaggccuuauucaagcuuaccaugcaccuccuaggcuucuucagcguugccugcucccuacuggccgccgcccuccucccuggcccccgcgaagcucccgcagccgcagcagccuuugaaucaggucucgaccuuagcgacgcagaacccgacgccggagaagcuaccgccuacgcgagcaaagaccucgaagaacaacugcgauccgucuccuccgucgacgaacucaugacuguacucuaccccgaauacuggaaaauguacaaaugccaacuccggaaaggaggcuggcaacacaacagagaacaagccaaccucaacucccgaaccgaagaaacuaucaaauucgccgcagcccacuacaacaccgaaauacucaaaucaaucgacaacgaauggagaaaaacccaaugcaugccccgagaagucugcaucgacgucggcaaagaguucggagucgccaccaacacauucuucaaaccaccuuguguauccgucuaccgaugcggagguugcugcaacuccgaaggccuacaaugcaugaacaccuccaccucauaccucucaaaaacacucuucgaaaucaccgucccccuaagccaaggcccgaaaccagucaccauuuccuucgcaaaccauacaucaugccgauguaugucaaaacucgacgucuaccgccaaguccacuccauaauccgacgcucacucccagccacccucccccaaugccaagcagcaaacaaaaccugcccaaccaacuacauguggaacaaccacaucugccgcugccucgcacaagaagacuucauguucagcuccgacgccggcgacgacuccaccgacggcuuccacgacaucugcggccccaacaaagaacucgacgaagaaacaugccaaugcguuugucgcgccggccuccgcccagccuccugcggaccacacaaagaacucgacagaaacuccugccaaugcguuugcaaaaacaaacuauucccaucccaaugcggagccaaccgcgaguucgacgaaaauaccugccaaugcguaugcaaacgaaccugcccccgaaaccaaccccuaaaccccggcaaaugcgcuugcgaaugcaccgaauccccgcaaaaaugccuccucaaaggaaagaaauuccaccaccaaaccugcuccugcuaccgccgacccugcaccaaccgucaaaaagcgugcgaacccggauucuccuacuccgaagaagucugccgcugcguccccagcuacuggaaacgcccccaaauguccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4823 - RNA, 1412 nt, Artificial Sequence
  mRNA product Design3 comprising derived and/or modified sequence from Homo sapiens__NP_004460.1__HsVEGFD (opt11)
gggagagucccgcagucggcguccagcggcucugcuuguucgugugugugucguugcaggccuuauucaagcuuaccauguaccgagaaugggucgucgucaacguauucaugaugcucuacguacaacucguccaaggcagcagcaacgaacacggccccgucaagagauccagccaaagcacccuagaacgauccgaacaacaaauacgcgcagccucaagccucgaagaguuacuacgaaucacccacucagaagacuggaagcucuggcgaugccgccuccgccucaaguccuucaccuccauggacagcagaucagccucccaccgcucaacccguuucgccgccaccuucuacgacaucgaaacccucaaagucaucgacgaggaauggcaacgaacacaaugcucucccagagaaaccugcguagaagucgccuccgaacuugguaaaucaaccaacacuuucuucaaaccacccugcgucaacgucuuccgcugcggaggcugcugcaacgaagagucccucauaugcaugaacacauccaccuccuacaucuccaaacaacucuucgaaauauccguaccccuaaccuccgucccagaacuuguacccgucaaagucgccaaccacaccggcugcaaaugccuccccacagcaccccgccaccccuacuccauaauccgccgaucgauacaaauaccggaagaagaccgcugcucacacucaaagaaacucugccccauagacaugcucugggacuccaacaaaugcaaaugcguccuccaggaagaaaacccccuagccggcacagaagaccacucccaccuccaagaaccagcccucugcggcccccauaugauguucgacgaagaccgcugcgaaugcguaugcaaaacccccugccccaaagaccucauccaacaccccaaaaacugcucaugcuucgaaugcaaagaaucacucgaaaccugcugccaaaaacacaaacucuuccaccccgacacaugcucaugcgaagaccgaugccccuuccacacccgccccugcgccuccggcaaaaccgccugcgccaaacacugccgauucccaaaagaaaaacgcgccgcccaaggcccccacucacgcaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4824 - RNA, 977 nt, Artificial Sequence
  mRNA product Design3 comprising derived and/or modified sequence from Homo sapiens__NP_061986.1__HsFGF21 (opt12)
gggagagucccgcagucggcguccagcggcucugcuuguucgugugugugucguugcaggccuuauucaagcuuaccauggauuccgacgaaaccggcuuugaacacucaggauuauggguaucaguauuagcaggacuacuacuaggagcaugccaagcacacccaauaccagacucaucaccauuauuacaauucggaggacaaguaagacaaagauaccuauacacagacgacgcucaacaaacagaagcacauuuagaaauaagagaagacggaacaguaggaggcgcagccgaccaaucaccagaaucuuuacuacaauuaaaagcacuaaaaccaggcguaauacaaauauuaggaguaaaaacaucaagauucuuaugccaaagaccagauggagcacuauacggaucacuacacuuugacccagaagcaugcucauucagagaauuacuauuagaagacggauauaacguauaccaaucagaagcacauggacuaccccuacaccuaccaggaaacaaaucaccacaucgagacccagccccaagaggccccgcaagauuccuaccacuaccaggacuaccaccagcacuaccagaaccaccaggaauauuagcaccacaaccaccagauguaggauccuccgacccauuaucaaugguaggaccaucacaaggaagaucuccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4825 - RNA, 1757 nt, Artificial Sequence
  mRNA product Design3 comprising derived and/or modified sequence from Homo sapiens__NP_002412.1__HsMMP1 (opt12)
gggagagucccgcagucggcguccagcggcucugcuuguucgugugugugucguugcaggccuuauucaagcuuaccaugcauucauucccaccucuauuacuacuauuauuuugggguguuguaucccacucauuuccagcuacauuagaaacacaagaacaagacguagaucuaguccaaaaauaucuagaaaaauacuacaaccuaaaaaacgacggacgccaaguagaaaaaagaagaaacaguggaccaguaguagaaaaacuaaaacaaaugcaagaauuuuuuggacuaaaagucacaggaaaaccugaugccgaaacuuuaaaaguaaugaaacaaccaagaugcggcguaccugacguagcacaauucgucuuaacagaaggaaacccaagaugggaacaaacgcacuuaacauaucgaaucgaaaauuacacaccagaccuaccaagagcagacguagaucacgcaauagaaaaagccuuccaacuauggucaaauguaacaccccuaacauucacaaaaguaucagaaggacaagcagauauaaugaucucauucguaagaggggaucacagagauaacucacccuucgauggcccaggaggaaaccuagcacacgcauuccaaccuggaccaggaauagguggugaugcacauuucgacgaagacgaaagauggacaaacaacuucagagaauauaaccuacacagaguagcagcucacgaacuaggucauucauuaggacuaagucauucaacagauauaggagcacuaauguacccaucauacacuuuuagcggagacguacaacuagcacaagacgacauagauggaauacaagcaauauacggaagaucacaaaaccccguacaaccaauaggaccacaaacaccaaaagcaugugacucaaaacucaccuucgacgcaauaacaaccauaagaggagaaguuauguucuuuaaagacagauucuacaugagaacaaaucccuuuuacccagaaguagaauuaaacuucaucucaguauuuuggccccaacuaccaaauggucuagaagcagccuacgaauuugcugauagagaugaaguaagauucuucaaaggaaacaaauauugggccguccaaggacaaaacguauuacacggauauccaaaagauaucuacuccucauucggcuuuccaagaacaguaaaacauauugaugcagcacuauccgaagaaaacacaggaaaaacauacuucuuuguagccaacaaauacuggagauaugaugaauacaaaagaucgauggacccaggauaccccaaaaugauagcacacgacuuuccaggaauaggacacaaaguagaugcaguauucaugaaagacggauucuucuacuucuuccacggcaccagacaauacaaauuugaccccaaaacaaaacgcauccuaacauuacaaaaagcaaauucaugguuuaacuguagaaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4826 - RNA, 1517 nt, Artificial Sequence
  mRNA product Design3 comprising derived and/or modified sequence from Homo sapiens__NP_002412.1__HsMMP1(1-19,100-469) (opt12)
gggagagucccgcagucggcguccagcggcucugcuuguucgugugugugucguugcaggccuuauucaagcuuaccaugcacucauucccaccacuauuauuacuacuauucuggggaguaguaucacacuccuucguauuaacugaaggaaauccucgaugggaacaaacccaccucacauauagaauagaaaacuacacaccagaccuaccuagagcagacguagaccacgcaauagaaaaagccuuccaauuaugguccaacgucacaccauuaacuuucacuaaagucucagaaggacaagcagauauaaugauauccuuugucagaggagaucacagagacaacucaccauuugacggaccaggaggaaaucuagcacacgcauuccaacccggacccggaauagguggagacgcacacuucgaugaagaugaaagauggacaaacaauuucagagaauacaauuuacacagaguagcagcacacgaacucggacacuccuuaggacucucccauucaaccgacauaggagcauuaauguacccaucauacacauucucaggagacguccaacuagcacaagacgauaucgacggcauacaagcuauauacggaagaucacaaaacccaguacaaccaaucggaccacaaacaccaaaagccugugacucaaaauuaacuuuugaugcaaucacaacuauacgaggcgaaguaauguuuuucaaagacagauucuacaugagaacaaaccccuuuuacccugaaguagaacuaaacuucauaucuguuuucuggccacaacuaccaaacggauuagaagcagcauacgaauuugccgacagagacgaaguuagauucuucaaaggaaacaaauacugggcaguucaaggacaaaacgucuuacacggauauccaaaagauauauacuccucauucggauucccaagaaccguaaaacacaucgaugccgcauuaucagaagaaaauacaggcaaaacauacuucuuuguugcaaacaaauauuggagauacgacgaauacaaacgcucuauggacccaggcuauccaaaaaugauugcacacgauuucccaggaauaggacacaaaguagaugcaguauucaugaaagacggauucuuuuauuucuuccacggaacaagacaauacaaauucgauccaaaaacaaaaagaauccuaaccuuacaaaaagccaacucaugguucaauugcagaaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4827 - RNA, 3704 nt, Artificial Sequence
  mRNA product Design3 comprising derived and/or modified sequence from Clostridium histolyticum__BAA77453.1__ColG (opt12)
gggagagucccgcagucggcguccagcggcucugcuuguucgugugugugucguugcaggccuuauucaagcuuaccaugaagaaaaacauacugaaaaucuuaauggacuccuacuccaaagaaucaaaaauccaaacaguaagacguguaacaucaguaucacuccuggcaguauaccuuacaaugaacacuucuuccuuaguauuagccaaaccaauagagaauacuaaugacacaucaaucaaaaauguagaaaaauuacgaaaugcacccaacgaagaaaacagcaagaaaguagaagauuccaaaaacgacaaaguagaacauguuaaaaacauagaagaagcuaaaguagaacaaguugcuccggaagugaaaucaaaaucaacguugagaagugcaaguauagcaaacaccaacuccgaaaaauaugacuucgaauacuuaaauggacuaucguacacagaauuaacaaauuuaauuaaaaacauaaaauggaaucaaauaaauggucuguucaacuauaguaccggcucccaaaaauucuucggagauaaaaaucguguucaagcuauaauaaaugcacuacaagaaucugguagaacauauaccgcuaacgauaugaaaggaauagagacuuuuacggaaguccuaagagccggauucuacuuaggauacuauaacgaugguuuaaguuauuuaaaugacagaaauuuucaagacaaaugcauaccggcaaugauagcaauacagaaaaacccuaacuuuaagcuaggaacagcuguccaagacgaaguaauuacaucacuagguaaacuuaucggaaaugcaagcgcaaacgcagaagucguaaauaauugugucccaguacuaaaacaauuuagagaaaauuuaaaccaauaugcuccagacuauguaaaaggaacagcaguaaaugaacuuauaaaagguauagaguucgacuucucaggagcagcauaugaaaaagacguaaaaacaaugccaugguauggaaaaaucgauccauuuauaaaugaauugaaggcauuaggccuauauggaaauauaaccagcgcgacagaaugggcaucagacgucggaauuuacuaccuuaguaaauucggacuauauagcacaaauagaaaugacauaguacaaagccucgaaaaagcgguagauauguacaaauauggaaaaauagcuuucguagccauggaacgaauaacaugggacuaugaugguauagguucaaacggaaagaaagucgaccacgauaaauuccuagacgaugcugaaaaacacuacuuaccaaaaaccuacacguucgauaauggaacuuuuauaauacgugcuggagacaaaguuucagaagagaaaaucaaaagauuauauugggcuucgcgagaaguaaaaucucaauuccaccgaguaguaggaaacgauaaagcauuagaaguuggaaaugcggacgauguauuaacaaugaaaauuuucaacucacccgaagaauauaaauuuaauacuaacauuaacgguguaagcacagauaacggagguuuauacauagaaccucgaggaacauuuuauacguaugaacgaacaccacaacaaagcauauuuucguuagaagaacuauuuagacaugaauauacacauuaccuacaagcacgauacuuaguagauggauuauggggucaaggacccuuuuacgaaaagaaucgccucacaugguucgaugaaggcaccgcugaguucuuugcuggcucgacgagaacaaguggagugcucccaagaaaaaguaucuuaggauaccuugcaaaagauaagguugaccaucguuauucacuaaagaaaacuuuaaauucagguuacgacgacagugauuggauguuuuacaauuacggauuugcaguagcacauuaucucuacgaaaaagacaugcccaccuuuauaaaaaugaauaaagcaauuuuaaacaccgauguaaaauccuacgaugaaauaauuaagaaacugagugaugacgccaacaaaaauaccgaauaucaaaaucacauccaagaauuagccgacaaauaccaaggagcagguauaccgcuagugagugaugacuaucucaaagaccacggcuauaagaaagcaucugaaguuuacuccgaaauuagcaaagcggcaucacucaccaauacuagcgucaccgcagaaaaaucccaauacuuuaauacauuuacucuucgaggcacauacacaggagaaacgagcaaaggagaauuuaaagacugggacgaaaugaguaagaaacucgauggaacauuagaaucauuagccaaaaacuccuggaguggcuacaaaacacuuacugcauacuucacaaauuauagaguaacaagugauaauaaaguacaauaugauguagucuuucacgguguauuaacagauaaugcagauauaucaaacaacaaagcaccaauagcaaaaguaacuggaccaucaacaggggcugucgggagaaauauugaguucucaggcaaagauucaaaagacgaagaugguaaaauuguuucguacgauugggauuuuggcgacggagcaacaagucgugguaaaaacaguguacaugccuacaagaaagccggaaccuacaauguaacauuaaaaguaaccgacgacaaaggagcaaccgccacagaaaguuuuacuauagaaauuaaaaaugaagacacaacaacccccauaacuaaagaaauggaaccaaacgacgacauaaaagaagcaaauggaccgaucguagaaggaguuaccguuaaaggagacuuaaacggcucagaugacgcagauacuuuuuacuucgaugucaaagaagacggagaugucacaauagaauuacccuacaguggaucuucaaacuuuaccuggcuagucuauaaagaaggagaugaccaaaaucauauagcaagcggaauagauaaaaacaacagcaaaguaggcacauucaaaaguacaaaaggcaggcauuacguauuuauauacaaacacgauucugccucaaacauuucuuacaguuuaaauauuaaaggucuaggaaaugaaaaacuaaaagaaaaagaaaacaacgacucaucugacaaagcaacaguaauaccuaacuucaacacaacaaugcaaggaucauuacuaggagaugacaguagagauuacuauucauuugaaguaaaagaagaaggugaaguaaauaucgagcuagauaagaaagacgaauuuggagugacauggacccuucacccagaaucaaauauaaacgaucgaauaacauauggacaagucgauggcaacaaaguaucaaauaaaguuaaauuaagaccaggaaaauauuaucuccuuguauacaaguauucaggcaguggaaacuaugaauugagaguaaacaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4828 - RNA, 3428 nt, Artificial Sequence
  mRNA product Design3 comprising derived and/or modified sequence from Clostridium histolyticum__BAA77453.1__HsALB(1-18)_ColG(111-1118) (opt12)
gggagagucccgcagucggcguccagcggcucugcuuguucgugugugugucguugcaggccuuauucaagcuuaccaugaaaugggucacauuuauuucacuacuguuuuuauucucaucagcauauaguauagcaaauacaaacagugaaaaauacgauuucgaauaucucaacggauugucauauacagaacuuaccaaccuuauuaaaaauauaaaauggaaccaaauaaauggucuauuuaauuacaguacggguucgcagaaauucuuuggagauaaaaaccguguacaggccauaauaaacgcacuacaggaauccggacgcaccuauacggcuaaugauaugaaaggaauagaaacuuuuacugaaguacuaagagccggauuuuaucucggauauuacaaugauggauugaguuaccuaaacgauaggaacuuucaagacaaauguauuccagcaaugauagcaauacagaaaaaccccaacuucaaauuaggcacagccguacaagacgaaguuauaacuucauuaggaaaauuaaucgguaacgcaagcgcaaacgccgaaguaguaaauaauuguguaccaguacuaaaacaauucagagaaaaccucaaccaauacgcacccgauuacguaaaagggacagcaguaaaugaauuaauaaaagguaucgaauuugacuucuccggagcagcuuaugaaaaagacguuaaaacuaugcccugguacggaaaaauagauccuuuuauaaaugaacucaaagcauuaggacucuaugggaauauaacaucggcuacugaaugggccagcgacguaggaauauauuauuuaucaaaauuugggcuauacucaacgaacaggaaugauauaguacaaucgcuagaaaaagccguagacauguauaaauaugguaaaauugcauucgucgcaauggaaagaauuacaugggauuaugacggaauaggguccaacggcaagaaaguagaucacgauaaauuuuuagacgacgcugaaaaacauuauuuaccaaaaacauauacuuuugacaacgguacauucaucauuagggcaggagauaaaguuuccgaagagaaaauaaaaagauuauacugggcaagucgagaaguaaaaucacaauuccacagaguaguaggcaacgauaaagccuuagaagucgguaaugcugacgauguauuaaccaugaaaauauucaacaguccugaagaauacaaauuuaauaccaauauaaauggaguaaguaccgauaauggcggacuauacauagaaccucgaggaaccuucuacacguacgaacgaacuccgcaacaaucaauauuuagucuagaagaacuauuucggcaugaauauacgcacuacuuacaagcuagauaucuuguagacggauuaugggggcaaggacccuucuaugaaaagaaucgauuaacaugguuugacgaaggaacugcugaauuuuucgcagguucaacaagaacgucaggaguacuaccaaggaaaaguauacuaggcuaccuugcaaaagauaaaguugaucaucgauauucacuaaagaaaacacuaaauagugguuaugacgacucagauuggauguucuauaacuaugguuuugcaguggcacauuaucuauaugaaaaagauaugccaaccuucauaaaaaugaacaaagccauauuaaauacugacgucaaaucauacgacgaaauaauuaagaaauuaucagacgaugcaaacaaaaauacagaauaucaaaaccauauacaagaauuagcagauaaauaucaaggugcagguauuccauuaguaucggaugauuauuuaaaagaucauggauacaagaaagccagcgaaguauacucugaaauuagcaaagcagcgucacucacgaauacaucuguuacugcagaaaaaucacaauauuuuaauacauuuacacugcguggaaccuauaccggagaaacaucaaaaggugaauuuaaagacugggacgaaaugucaaagaaacuagauggaacccucgaaaguuuagccaaaaauucauggaguggauauaaaacucuuacugcauacuucacuaauuacagaguaacaucagacaacaaaguacaauacgacguaguauuucauggcgucuugacagauaaugccgacauuucaaauaacaaagccccaauagcuaaagugacaggaccaucaacaggcgcagucggaagaaauauugaguucucagggaaagauaguaaagacgaagauggaaaaauaguuagcuaugacugggacuucggagauggagcaacaucucgagguaaaaacuccguacacgcauauaagaaagcuggaaccuauaacguuacauuaaaaguaacugaugauaaaggagcaacugcaacagaaaguuuuacuauagaaaucaaaaacgaagauaccacaacaccaauaacaaaagaaauggaaccaaacgacgacauaaaagaagcgaauggacccauaguagaaggagucacuguuaaaggagacuuaaaugggagcgacgaugccgacacuuuuuauuucgacguuaaagaagauggagacguaacuauagaauuacccuacucuggaaguaguaauuuuaccuggcuaguauacaaagaaggcgaugaucaaaaccauauagcgucaggaauagauaaaaauaauucaaaagugggcacuuucaaaagcacaaaaggaagacauuacguauucauuuauaaacacgauucagcaucaaacauaucauacucgcuuaauauaaaaggacuaggaaacgaaaaacuuaaagaaaaagaaaacaaugacucaucagacaaagccacaguaauuccaaauuuuaacacuacuaugcaaggaagccuuuuaggagaugauaguagagauuauuauucauucgaaguaaaagaagaaggagaaguuaauaucgaacuagauaagaaagaugaguucgguguaacguggacauuacacccugaauccaauauuaacgacagaaucaccuauggacaaguugacggaaauaaagucagcaacaaaguuaaauuaagacccggaaaauauuaccuccuaguuuauaaauauagcggaucaggaaacuacgaauuacgaguaaauaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4829 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt12)
gggagagucccgcagucggcguccagcggcucugcuuguucgugugugugucguugcaggccuuauucaagcuuaccaugaaauggguaacauucauaucauuacuuuuccuauuuucaucagcauacaguaugaagaaaaauauauuaaaaauauuaauggacagcuauagcaaagaaucaaaaauacaaacaguuagaagaguaacuagcguuagcuuauuagccguauacuuaacaaugaauacaaguagccuaguauuagcaaaaccgauagaaaauacaaacgacacgagcaucaaaaacguugaaaaacuaagaaaugcccccaacgaagaaaacaguaagaaagucgaagacaguaaaaaugauaaaguagaacaugugaaaaacauagaagaagccaaaguagaacaaguagccccugaaguuaaaagcaaaucaacgcuacgcagcgccaguaggagaagaagaaaaagaauagcaaauacuaacucagaaaaauaugacuucgaauacuuaaauggacuaaguuacacagaacuuaccaaucuuaucaaaaacauaaaauggaaucaaauaaauggacuauucaauuauuccacugggucacaaaaauuuuucggagauaaaaauagagugcaggcuauaauuaacgcacuacaagaaucaggaagaaccuacacagcaaacgauaugaaagggauagaaacuuucacugaaguacugcgagcgggauucuauuugggguacuauaacgacgguuuaucauacuuaaacgacagaaauuuucaagacaaauguauaccagcaaugauagcaauacagaaaaauccuaauuuuaaacuagggaccgcaguacaagacgaagugauaacaucacucgguaaacucauaggaaaugcuucagcuaaugcggaaguaguaaauaauugcguaccaguuuuaaaacaauucagagaaaaccucaaccaauaugcacccgacuauguaaaaggaacugcaguuaacgaacuuaucaaaggaaucgaauuugauuuuagcggagccgcguacgaaaaagacgugaaaacaaugccuugguauggaaaaauagacccauucauuaacgaauuaaaagccuuaggccuguacgguaauauaacuucagccacagaaugggcaagugacguuggcauauacuauuugucgaaauuuggauuguauucaacaaaccguaacgacauaguucaaagccuggaaaaagcaguagauauguacaaauauggaaaaauagccuuuguagcaauggaaaggauuacaugggauuaugacggaauaggcucaaaugguaagaaaguagaucaugauaaguuucuagacgaugcagaaaaacacuaucuuccaaagacauacaccuucgacaauggaacuuuuauuauaagggcaggcgacaaaguauccgaagagaaaauaaaacguuuauacugggcaucacgggaaguaaaaagccaauuucauagaguaguaggaaacgacaaagcauuagaaguaggaaacgcagaugacguacucacaaugaaaauauucaauucuccugaagaauauaaauucaauacaaauauaaauggagucaguacagacaauggaggacuauacauagaaccuagagggacauuuuauacuuacgaaagaacaccccaacaauccauauuuucccuagaagaauuguuccgacaugaauacacacauuauuuacaagcccgauacuuaguagacggauuauggggacaagguccauucuacgagaaaaacagauugacaugguucgacgaaggaacagcagaauuuuucgccggaucaacuagaaccuccgguguauuaccaagaaaauccauccuuggguacuuagcaaaagauaaaguagaucaucguuauucguuaaagaaaacauuaaauagcggcuacgaugauucagauuggauguuuuauaauuauggcuuugcuguagcacauuaucuauacgaaaaagauaugccaacuuucaucaaaaugaacaaagcgaucuuaaauacagacguuaaaucauaugacgaaaucauaaagaaauuaucagaugaugcaaauaaaaacacagaauaucaaaaccacauacaagaacuagcugauaaauaucagggugcaggaaucccacucguaucggacgauuaccuaaaagaccauggauauaagaaagcaagcgaaguauacucagaaauuaguaaagcugcaucucuuacaaauacaagcguaacggcagagaaaagccaauauuucaacacguucacacuacgcggaacauauacuggagaaacaaguaaaggagaguucaaagauugggacgaaaugucaaagaaauuagaugguacuuuagaaucauuagccaaaaauagcugguccggguacaaaacacuuaccgcauacuuuacaaauuauagagucacaagcgauaauaaaguucaauacgaugucgucuuucacggaguacuaacagacaacgcggauauaagcaauaauaaagcaccaauagcaaaaguaacaggaccaucaaccggagcuguuggaagaaacauugaguucucaggaaaagacucaaaagacgaagauggcaaaauaguaagcuaugauugggauuuuggagacggcgcaacauccagaggcaaaaauagcguccaugccuauaagaaagcaggaacauacaacguaacauuaaaaguaacagacgacaaaggagccaccgccacugaaaguuuuacuaucgaaaucaaaaaugaagauacaaccaccccaauaaccaaagaaauggaaccuaaugaugacauaaaagaagcuaaugggccaauuguagaaggagucacagucaaaggcgacuuaaacgggagcgacgacgcugauaccuucuacuuugacguaaaagaagauggagauguaacaauagaacuaccauauucagguucauccaauuuuacauggcuaguguacaaagaaggugacgaccaaaaccauauagccaguggaauugacaaaaacaauucuaaaguggggacuuuuaaaagcacaaaagguagacauuauguauuuauauacaaacaugauagugcaagcaacauaucauacucucuaaauaucaaaggcuuaggaaacgaaaagcuaaaggaaaaggaaaauaacgauuccucagauaaagcaacugugaucccaaauuucaacacuacuaugcaaggcagccuucucggugaugauagccgagauuacuacuccuuugaagucaaagaagaaggugaagucaacauagaauuggauaagaaagaugaguucggcgucacauggacacugcauccagaaucaaacauaaacgauagaaucaccuacggacaagucgacggaaauaaaguaagcaauaaagucaaauuaagaccaggaaaauacuaccuucuaguauauaaauacucuggaaguggaaauuacgaauuacgaguuaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4830 - RNA, 3452 nt, Artificial Sequence
  mRNA product Design3 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaacuuuuugaagauaauacuaaauagaggaaaaacaaugaaaagaaaaugccuauccaaacgauuaaugcuggccauaacuauggcaacaauauuuacaguaaacaguacauuaccuauauaugcagcuguagauaaaaacaacgcuacagcugccguccagaacgaaucuaaaagguacaccguaucuuaucuaaaaacucuaaacuacuaugacuuaguagauuugcuaguaaaaacagaaauagagaaucuaccagacuuauuucaauauucaagcgaugccaaagaguucuauggaaauaaaaccagaaugaguuuuauaauggaugaaauagguagacgagcaccacaauacacagaaaucgaccauaagggaauaccgacacuuguagaagugguaagagcaggauucuauuuaggauuccauaauaaagaauuaaacgagauaaacaaacgauccuuuaaagaaagagucauaccaagcauauuagcaauccagaaaaauccaaauuucaagcuaggaacagaaguacaagauaaaauuguaagcgcaacaggauuacucgcagggaacgaaacagcacccccagaagucgugaacaacuucaccccaauacuccaagacuguaucaaaaauauagauagauacgcacuagaugaccuaaaaaguaaagcccuuuucaacguacuugcagcaccaaccuaugauauaacugaauaccuacgagcaacaaaagagaaaccagaaaacacacccugguacgggaaaauagacggcuuuauaaaugaguuaaagaaauuagccuuauaugguaaaauaaaugauaauaauucauggauaauagacaacggcauuuaucauaucgcaccucugggaaaauuacacaguaauaacaaaauagguauugaaacacuaacagaaguaaugaaaguuuauccauaucuaagcaugcaacaccuccaaucagcagaucaaauaaaacgacacuacgacucuaaggacgcagaagggaacaaaauaccacuagacaaauucaagaaagaaggaaaagaaaaauacugcccaaaaacauauacauucgacgauggcaaaguaauuaucaaagcuggcgcaaggguagaggaagaaaaaguaaaacgucuauauugggcuucaaaagaaguaaauucacaauucuuucgaguuuacggaauugauaaaccauuagaagaaggaaacccagaugacauucuaacuaugguuauauauaauucaccagaagaauauaaacuaaacucaguauuauacggauaugauaccaacaacggugggauguacauagaacccgaaggaacauucuuuacuuaugaacgcgaagcacaagaaagcacuuacacguuagaagaacuauuccgacacgaauauacacauuacuuacaaggacgcuaugcaguuccaggacaauggggacgaacaaaauuauaugauaacgacagacuaacaugguacgaagaaggaggagcagaauuauuugcugguaguacucgaacaaguggaauacuacccagaaaaagcauuguaagcaacauacauaauacaacacgcaacaacagauauaaacuaucagauacuguacauuccaaauauggcgccagcuuugaguucuacaacuacgcaugcauguucauggacuacauguacaauaaagacauggguauacucaacaaacuaaacgaucucgccaaaaauaacgacguugacggauaugauaauuacauuagagaccucaguucaaauuaugcauuaaaugacaaauaccaagaucacaugcaagaaagaauagauaacuaugaaaacuuaacaguaccauucguugcagacgauuacuuaguaagacacgcauauaaaaacccuaacgaaauauauucggaaauuucagaaguugcaaaauuaaaagaugcaaaaucugaaguaaagaaaagucaauauuuuucgaccuucacauuacguggaagcuauacaggaggugcauccaaaggaaaacucgaagaucaaaaagcaaugaacaaauuuauagacgacucuuuaaagaaacuagacacauauucguggagcggguacaaaacauuaacggcauacuucacgaauuauaaaguugacaguucaaauagagucacauaugauguagucuuucacggauaccuaccuaacgaaggagacaguaaaaauagucuccccuaugggaaaauaaauggcacauacaaagguaccgagaaagagaaaauaaaauuuuccucggaaggcucauucgacccugauggaaaaauaguaucauacgaaugggacuucggagauggaaauaaaaguaacgaagaaaauccagaacacucauacgauaaaguagggaccuauaccguaaaacucaaaguaacagaugacaaaggcgaaagcucaguuucaacaacaacugcagaaauuaaagauuuaucagaaaauaaauuaccaguaauauauaugcauguaccaaaaaguggggcacuaaaucaaaaaguaguguucuaugggaaaggaacauaugauccagacggaucaauugcagguuaccaaugggauuuuggagaugguucagauuucucaagugaacaaaauccaucccacguuuauacaaagaaaggagaauacacaguaacuuuacgaguaauggacaguucagggcaaaugucggagaaaacaaugaaaauuaaaauaacagauccaguauacccaauaggaacagaaaaagaaccuaauaauucaaaagaaacugcaucagggccaauaguacccggaauacccguauccgguacuauagaaaacacaucagaucaagacuacuucuauuuugauguuauaacgccaggagaaguaaaaauagauaucaacaagcuaggauauggaggagcaacguggguaguguaugaugaaaauaauaacgcaguuucauaugcaacugacgauggacaaaaccucuccggaaaauucaaagcagauaaaccaggaagguauuacauacaccuguacauguucaauggcucuuauaugccguaucguauaaauaucgaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4831 - RNA, 3413 nt, Artificial Sequence
  mRNA product Design3 comprising derived and/or modified sequence from Clostridium histolyticum__BAA34542.1__ColH (opt12)
gggagagucccgcagucggcguccagcggcucugcuuguucgugugugugucguugcaggccuuauucaagcuuaccaugaaacgaaaaugcuuaucaaaaagauuaauguuagcaauaacaauggccacuauauucacugucaauucaacccuuccaauauacgccgcaguagacaagaacaaugcuacagcagcaguacaaaaugaaaguaagagauacacaguaucguaucuaaaaacucuaaacuauuaugaccucguggaccugcuaguaaaaacagaaauagaaaauuuaccugauuuauuccaguauucaucagaugcaaaagaguucuauggcaauaagacaagaauguccuucauaauggaugaaauaggcagacgagcaccacaauacacugaaauugaccacaagggaauaccaacccuagucgaaguagucagagcaggauucuaccuaggcuuccauaauaaggaacuaaacgaaauaaacaaaagaaguuucaaagaaagagugauaccaucaauauuagcaauacagaaaaaucccaacuuuaaacuuggaacagaaguacaagacaaaauugugagcgcaaccggauuacuagcagggaacgaaacagcaccucccgaaguagugaauaauuuuacgccaauauuacaagauugcauuaaaaacauagacagauaugcacuagaugauuuaaaaucuaaagcauuauuuaacguacuagcagcucccacauaugauauaacagaauaccucagagccaccaaagaaaaaccugaaaauacaccaugguauggaaaaaucgacggcuuuaucaaugaacuuaaaaagcuagcacuauauggaaaaaucaacgauaacaacucauggaucauagauaauggaauauaccauauagcacccuuaggcaaacuucacucaaacaauaaaaucggcauagaaacauuaacggaaguaaugaaaguauacccuuaucuaucuaugcaacauuuacaaucagcagaucaaauaaaacgccacuacgauaguaaagaugcagaaggaaacaaaauaccccucgacaaguucaagaaagaaggaaaagaaaaauauuguccaaaaacauauacguucgacgauggaaaaguaauaauaaaagcaggagcaagaguagaagaggaaaaaguaaaaagauuauacugggcgucaaaagaaguaaacucacaauucuucagaguuuauggaauagacaaaccauuagaggaaggaaaucccgaugacauucuuaccauggugaucuacaacaguccugaagaauauaaacuaaauucuguccucuacggauaugauacaaacaacggaggcauguauaucgaaccagaaggaaccuuuuucacauaugagagagaagcucaagaaucaaccuacacccucgaggaacuauucagacacgaauauacgcacuaucuacaaggcagguacgcaguacccggacaauggggccguacaaaacuauaugacaacgacagacuaacuugguacgaagaaggaggggcugaauuauuugccggaucaacaagaaccucagggauucuuccacgaaaaucgauaguuucgaauauacacaauacaaccagaaacaauagauauaaauuaucagauacagugcauuccaaauauggggcuucauucgaguuuuacaauuaugcuugcauguucauggauuauauguauaacaaagacaugggaauacucaacaaacuaaaugaccucgcuaaaaacaaugacguagauggauacgacaauuacauacgcgauuuaagcuccaacuaugcauuaaacgacaaauaucaagaucauaugcaagaaagaauagauaauuaugagaaucuaacaguaccguucgucgcagaugauuacuuagugcggcacgcauauaaaaacccuaaugaaauuuauagcgaaauaagugaaguugcaaaauuaaaagacgcaaaaagugaaguaaagaaaucacaauacuuuagcacauucacauuaagaggaaguuauacuggaggagccuccaaagguaaacuagaagaccaaaaagcuaugaacaaauuuauagaugauagucuuaagaaacuugacaccuauucauggaguggauauaaaacauuaacagcuuauuucacuaacuauaaaguagauucaucaaaucgcguaacuuaugaugucguuuuccacgguuauuuacccaacgaaggagacaguaaaaacucacuaccauacgguaaaauaaauggcacuuacaaaggaacagaaaaagagaaaauaaaauucaguucugaaggaucauucgacccagauggaaaaauagugagcuaugaaugggacuucggagaugguaauaaaagcaaugaagaaaauccagaacacaguuaugacaaaguagguacauacacuguuaaauuaaaagucacagacgauaaaggcgaaaguucaguaucaacaacaacagccgaaauaaaagaucuaagcgaaaacaaacuacccgucauauauaugcacguaccuaaaaguggagcccuuaaccaaaaagugguauucuacggaaaaggaacauacgacccugacggaagcauagcaggauaucaaugggacuucggugacgguucggacuucucuucugaacaaaauccaagccacguauacacaaagaaaggagaauacaccguaacacuuagaguuauggacagcucaggacaaaugucagagaaaacaaugaaaaucaaaauuaccgacccuguauauccaauaggaacugaaaaagaaccaaauaacaguaaagaaacagcuaguggaccgaucguuccagguauuccuguaaguggaacaaucgaaaacacaucagaccaggacuauuuuuauuucgauguaauaacaccaggagaagucaaaaucgauauaaauaaacuaggauauggaggggcuacauggguaguauacgaugaaaacaacaaugcaguauccuacgcgacagaugacggacagaaccuuucaggaaaauucaaagcggacaaaccaggcagguacuacauacaccuauacauguucaacggauccuauaugccuuaucgaauuaauauagaaggauccguaggccguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4832 - RNA, 3347 nt, Artificial Sequence
  mRNA product Design3 comprising derived and/or modified sequence from Clostridium histolyticum__BAA34542.1__HsALB(1-18)_ColH(41-1021) (opt12)
gggagagucccgcagucggcguccagcggcucugcuuguucgugugugugucguugcaggccuuauucaagcuuaccaugaaaugggugacauucauaucucuacuuuuccuauucuccucagcauacucaguacaaaacgaaucaaaaagauacacagugaguuacuuaaaaacguuaaacuacuaugaccuaguagaccuucuaguaaaaaccgaaauagaaaaucuaccagaccuauuccaauacucuucagaugccaaagaauuuuauggaaauaaaaccagaaugaguuucaucauggaugaaaucggaaggagagcaccacaauacacggaaauagaucacaaagguauacccacuuuaguagaagucguaagagcaggauucuacuuaggauuccauaacaaagaacucaaugaaauuaauaaaagaucuuucaaagaaaggguaauacccagcauacucgccauacagaaaaaccccaacuucaaacuaggaacagaaguacaagauaaaauaguaucagcaacugguuuacucgcuggaaaugaaaccgcaccaccagaaguaguaaacaacuucaccccuauucuacaagacugcauuaaaaauauagacagauacgcccuagacgacuuaaaaucgaaggcccucuuuaacguacuagccgccccaacauaugauauaacagaauacuuaagagcaaccaaagaaaaaccagaaaauacacccugguacggaaaaauagacggauuuauaaaugaauuaaagaaauuagcguuauaugggaaaauaaacgacaauaauaguuggauaauagacaacggaauauaccacauagcaccauuaggcaaacuacacuccaauaacaaaauagggauagaaaccuuaacagaaguaaugaaaguauauccauaucuaucaaugcaacauuugcaaucagcagaccaaauaaaacgacauuaugauaguaaagacgcagaaggaaauaaaauaccacuagauaaauucaagaaagaaggaaaagaaaaauauuguccaaaaacauacacauucgaugacggaaaaguaauaauuaaagccggugcccggguagaagaagaaaaaguaaaacgacuguauugggcuucuaaagaagucaauucacaauucuuuaggguauacggaauugauaaaccucuagaagaagguaacccagacgacauccuaacaauggucauauacaauagcccggaagaauacaaauuaaacucgguauuauacggguaugacacaaauaacggcggcauguacauugaacccgaaggaacguucuucacauaugaaagagaagcacaagaaucaacauacacacucgaagaacuauuuagacacgaauauacacauuauuuacaagggagauacgccguacccggacaauggggucgaaccaaacuuuacgacaacgacaggcuaacaugguacgaagaagggggagcagaauuauucgcaggaucaacaagaaccucaggaauacuaccuagaaaaaguauaguaucaaauauacauaauacaaccaggaauaacagauauaaauuaagugacacaguccauucaaaauauggagccuccuuugaguucuauaacuacgcauguauguucauggauuacauguacaacaaagauaugggaauccuaaacaaacuaaacgaccuagcuaaaaauaacgauguugacggauacgauaacuacauaagagaccucagcucaaacuaugcacuuaacgacaaauaucaagaucauaugcaagaaagaauagacaacuacgaaaaucucacaguaccauucguagcagacgauuauuuaguaagacacgcauacaagaacccuaacgaaaucuauuccgaaauuagcgaaguagcgaaacuuaaagacgcaaaaagugaaguaaagaaaagucaauacuucagcacauucacacuacgaggauccuacacaggcggcgcaagcaaaggcaaacuagaagaucaaaaagcaaugaacaaauucauagacgauucacucaagaaauuagauacauauagcuggaguggauacaaaacacuaacugcauauuucacaaacuacaaaguugacagcucaaauagagucacauaugauguaguauuccacggauaucuacccaaugaaggugacagcaaaaacuccuuaccauacggaaaaauuaacgggacauacaaaggaacagaaaaagagaaaauaaaauucucauccgaagguagcuuugaccccgauggaaaaauuguaucauaugaaugggacuucggagacggaaauaaaucaaacgaagaaaauccugaacacagcuaugauaaaguuggcaccuauaccgugaaacuaaaagugacagaugacaaaggugaaucauccguauccacaacgacagcagaaauuaaagacuuaagcgaaaacaaacuaccaguaauauacaugcauguaccaaaauccggcgcauuaaaucaaaaagucguauuuuauggaaaagggacuuaugaccccgaugggucaaucgcaggcuaucaaugggacuucggcgauggcucagacuucucaucagaacagaacccaucucauguuuacacaaagaaaggagaauacacaguaacauuacgagucauggauucaucaggucaaaugucagagaaaacaaugaaaauaaaaauaacagauccgguuuacccaauaggaacagaaaaagaacccaacaauucaaaagaaacagcaaguggcccuauaguuccagguauuccuguaucagguacaaucgaaaacacaucagaccaggauuacuuuuacuucgacgugauuacgccaggagaaguuaaaaucgauauuaauaaauuaggauaugguggagccacguggguaguauacgaugaaaauaauaaugcaguaucauaugccacagaugacggacaaaaucuuucagggaaauuuaaagcugauaaaccaggaagauauuauauacaccuuuacauguucaacgguucauacaugccuuacagaauaaauauagaaggauccguagguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4833 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt12)
gggagagucccgcagucggcguccagcggcucugcuuguucgugugugugucguugcaggccuuauucaagcuuaccaugaaaugggugacauucaucucacuauuauuucuauucaguagcgcauauucuaugaaacgaaaaugcuuauccaaaagacuaaugcuagcaauaacaauggcaacaaucuucaccguaaauucaacauuaccaaucuacgcagccguagauaaaaacaaugcaacagcagcucgaaggagaaggaaaaggguacaaaacgaaagcaaaagauauaccgucagcuaccuuaaaaccuuaaauuacuacgacuuaguagaucucuuaguaaaaacagaaauagaaaacuuacccgauuuguuucaauauucauccgacgcaaaagaguucuacggaaauaaaacaagaaugagcuucauaauggacgaaauaggucggagagcuccccaauauaccgaaauagaucauaaaggaauaccaaccuuaguagaaguaguaagagccggauuuuaccuuggcuuccauaacaaagaacuaaacgaaauaaacaaacgauccuucaaagagcgcguaauaccaaguauacuggccauccagaaaaacccaaacuuuaaauuaggaacggaaguucaagacaaaauaguaagugcaacagggcuccuagcaggaaacgaaacagcucccccugaaguuguaaauaacuucacaccaauacuucaagacuguauuaaaaacauagacagauacgcauuagacgaccuuaaaagcaaagcguuauuuaacguacuagcugcacccacuuaugacauaacugaauacuuaagagcaacaaaagaaaaaccagaaaacacaccuugguauggcaaaauagauggauuuauaaaugaacuaaagaaacuggcacuauauggcaaaaucaacgauaauaacaguuggauaauagacaacgguauauaucauauagcaccacuagguaaauugcauucaaacaauaaaauugguauagaaacguuaacagaggugaugaaaguauacccauaccuaucuaugcaacauuuacaaucagcggaucaaauuaaaaggcacuaugauucaaaagaugcggaagguaacaaaauaccacuagacaaauucaagaaagaaggaaaagaaaaauauugucccaaaacauacacauuugaugaugguaaaguaauaauaaaagcaggggcucgaguagaagaagaaaaaguuaaacgacuauacugggccucaaaagaagucaacucucaauuuuuccgcguauacggaaucgauaaaccauuagaagaagguaauccggaugauauauuaaccauggugaucuacaacucaccagaagaauacaaacuaaauucaguccuauauggauacgacacuaauaaugguggaauguacauagaaccagaaggcacauucuucacauacgaaagagaggcucaagaaucaacauacacacuagaagaauuauuccgacacgaauacacacauuacuuacaaggaagauacgcgguacccggacaauggggaagaacaaaacuauacgauaaugaucgacuuacaugguaugaagaaggaggagccgaacuauucgcaggauccacgcgcaccucagggauucuuccaagaaaaucaauaguaucaaauauacacaauacaacacgaaauaacagauauaaauuaucagacacaguacacuccaaauauggcgcaaguuucgaguucuacaauuacgcauguauguucauggauuacauguauaacaaagauauggggaucuuaaacaaacuaaacgauuuagcgaaaaacaaugacguagacggcuaugacaacuacauacgagacuuauccagcaauuacgcacuuaacgauaaauaccaagaucacaugcaagaaagaauagauaacuacgaaaaucuaacagucccauuugucgcagacgacuaccuggugagacacgcuuacaaaaauccaaaugaaauauacucagaaauaagcgaaguagcuaaacucaaagacgccaaaagugaaguuaagaaaagucaauacuuuucaacauucacccuccggggaucauauaccgggggagcaucuaaaggaaaauuagaagaccaaaaagccaugaauaaauuuauagaugacucccuaaagaaacuggacacuuacuccuggaguggguacaaaacuuuaacagcuuauuucaccaacuauaaaguagacagcagcaaucgagucacauaugacgucguguuucaugguuacuuaccaaacgaaggagacagcaaaaacucacuucccuaugguaaaauaaacgguacauacaaaggaacagaaaaagagaaaauuaaauucucuucugaaggaucauuugauccagauggaaaaaucgugaguuaugaaugggacuuuggagacggaaacaaaucuaacgaagaaaacccagaacacaguuaugauaaaguuggaaccuacacaguaaaacuaaaagugacugacgauaaaggagaaucaucagucaguacaacuacagccgaaauaaaagaucuaagcgaaaauaaacuccccguaauauauaugcacgucccaaaaucaggagccuuaaaucaaaaaguugucuuuuacgguaaaggaacauacgaucccgauggaucaaucgcaggauaucaaugggacuuuggagaugguagcgauuucuccagcgaacaaaaccccucacacguauauacaaagaaaggagaguauacaguaacauuaagagugauggauagcucgggacaaaugucagagaaaacaaugaaaauaaaaauuacggauccaguauaccccauaggaacagaaaaagaaccaaacaauuccaaagaaaccgcuagugguccaaucguacccggcauuccggugagcgguacuauagagaacacaucagaccaagauuacuuuuacuucgacgucauuacaccaggcgaaguaaaaauagauauaaauaaauuagguuacggaggugcaacuuggguaguauaugacgagaacaacaacgccgucucauacgcaaccgacgacggucaaaaucuaucaggaaaauucaaagcagacaaaccagguagauacuacauucaccuauacauguucaauggaaguuacaugccauacagaauaaacauagaaggauccguuggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4834 - RNA, 923 nt, Artificial Sequence
  mRNA product Design3 comprising derived and/or modified sequence from Homo sapiens__NP_001133.1__HsAMELX (opt12)
gggagagucccgcagucggcguccagcggcucugcuuguucgugugugugucguugcaggccuuauucaagcuuaccaugggaacauggauacuuuucgcaugccuacucggagcagcauucgcaaugccacuaccaccacacccaggacacccaggauacauaaacuucucauacgaaguacuaacaccacuaaaaugguaccaaucaauaagaccaccauacccaucauacggauacgaaccaaugggaggaugguuacaccaccaaauaauaccaguacuaucacaacaacacccacccacacacacauuacaaccacaccaccacauaccaguaguaccagcacaacaaccaguaauaccacaacaaccaaugaugccaguaccaggacaacacuccaugacaccaauacaacaccaccaaccaaaccuaccaccaccagcacaacaaccauaccaaccccaaccaguacaaccacaaccacaccaaccaaugcaaccacaaccaccaguacacccaaugcaaccacuaccaccacaaccaccacuaccaccaauguucccaaugcaaccacuaccaccaaugcucccagaccuaacacuagaagccuggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4835 - RNA, 482 nt, Artificial Sequence
  mRNA product Design3 comprising derived and/or modified sequence from Homo sapiens__NP_001133.1__HsAMELX-TRAP (opt12)
gggagagucccgcagucggcguccagcggcucugcuuguucgugugugugucguugcaggccuuauucaagcuuaccaugccucuaccuccacauccaggucacccuggauauauaaauuucucuuacgaaguacuuacaccucuaaaaugguaucaaucuauacguccaccuuacccuucauauggauaugaaccuauggguggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4836 - RNA, 515 nt, Artificial Sequence; identical to SEQ ID NO: 4376
  mRNA product Design3 comprising derived and/or modified sequence from Homo sapiens__NP_001133.1__HsAMELX-LRAP (opt12)

SEQ ID NO: 4837 - RNA, 554 nt, Artificial Sequence; identical to SEQ ID NO: 4377
  mRNA product Design3 comprising derived and/or modified sequence from Homo sapiens__NP_001133.1__HLA-A2-SP_HsAMELX(17-60) (opt12)

SEQ ID NO: 4838 - RNA, 587 nt, Artificial Sequence
  mRNA product Design3 comprising derived and/or modified sequence from Homo sapiens__NP_001133.1__HLA-A2-SP_HsAMELX(17-47,168-191) (opt12)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauacauaaacuucucauacgaaguacuaacaccacuaaaaugguaccaaucaauaagaccaccaccaaugcuaccagaccuaacacuagaagcauggccaucaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4839 - RNA, 926 nt, Artificial Sequence
  mRNA product Design3 comprising derived and/or modified sequence from Homo sapiens__NP_001134.1__HsAMELY (opt12)
gggagagucccgcagucggcguccagcggcucugcuuguucgugugugugucguugcaggccuuauucaagcuuaccaugggaacauggauccuauucgcuugccuaguaggagcagcauucgccaugccauuaccaccacacccaggacacccaggauacauaaacuucucauacgaaguacuaacaccacucaaaugguaccaaucaaugauaagaccaccauacucaucauacggauacgaaccaaugggaggauggcuacaccaccaaauaauaccaguaguaucacaacaacacccauuaacacacacacuacaaucacaccaccacauaccaguaguaccagcacaacaaccaagaguaagacaacaagcacucaugccaguacccggacaacaaucaaugacaccaacacaacaccaccaacccaaccuaccacuaccagcacaacaaccauuccaaccacaaccaguccaaccacaaccacaccaaccaaugcaaccacaaccaccuguacaaccaaugcaaccacuauuaccacaaccaccacucccacccauguucccacuaagaccacuaccaccaauacuaccagaccuacaccuagaagcauggccagcaacagacaaaacaaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4840 - RNA, 485 nt, Artificial Sequence; identical to SEQ ID NO: 4380
  mRNA product Design3 comprising derived and/or modified sequence from Homo sapiens__NP_001134.1__HsAMELY-TRAP (opt12)

SEQ ID NO: 4841 - RNA, 518 nt, Artificial Sequence
  mRNA product Design3 comprising derived and/or modified sequence from Homo sapiens__NP_001134.1__HsAMELY-LRAP (opt12)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4842 - RNA, 557 nt, Artificial Sequence; identical to SEQ ID NO: 4382
  mRNA product Design3 comprising derived and/or modified sequence from Homo sapiens__NP_001134.1__HLA-A2-SP_HsAMELY(17-61) (opt12)

SEQ ID NO: 4843 - RNA, 590 nt, Artificial Sequence; identical to SEQ ID NO: 4383
  mRNA product Design3 comprising derived and/or modified sequence from Homo sapiens__NP_001134.1__HLA-A2-SP_HsAMELY(17-48,169-192) (opt12)

SEQ ID NO: 4844 - RNA, 917 nt, Artificial Sequence
  mRNA product Design3 comprising derived and/or modified sequence from Sus scrofa__NP_999071.1__SsAMELX-001-1 (opt12)
gggagagucccgcagucggcguccagcggcucugcuuguucgugugugugucguugcaggccuuauucaagcuuaccaugggaaccuggauauuauucgcaugccuacuaggagcagcauucucaaugccacuaccaccacacccaggacacccaggauacauaaacuucuccuacgaaguauuaacaccacuaaaaugguaccaaaacaugauaagacaccccuacacaucauacggauacgaaccaaugggaggauggcuacaccaccaaauaauacccguaguaucacaacaaacaccacaaucacacgcacuacaaccccaccaccacauaccaaugguaccagcacaacaaccaggaauaccacaacaaccaaugaugccacuaccaggacaacacucaaugacaccaacacaacaccaucaaccaaaccuaccacuaccagcacaacaaccauuccaaccacaaccaguacaaccacaaccacaccaaccacuacaaccccaaucaccaaugcaccccauacaaccacuacuaccacaaccaccacuaccaccaauguucucaaugcaaucacuacuacccgaccuaccacuagaagcauggccagcaacagacaaaacaaaacgcgaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4845 - RNA, 485 nt, Artificial Sequence; identical to SEQ ID NO: 4385
  mRNA product Design3 comprising derived and/or modified sequence from Sus scrofa__NP_999071.1__SsAMELX-TRAP (opt12)

SEQ ID NO: 4846 - RNA, 518 nt, Artificial Sequence; identical to SEQ ID NO: 4386
  mRNA product Design3 comprising derived and/or modified sequence from Sus scrofa__NP_999071.1__SsAMELX-LRAP (opt12)

SEQ ID NO: 4847 - RNA, 557 nt, Artificial Sequence; identical to SEQ ID NO: 4387
  mRNA product Design3 comprising derived and/or modified sequence from Sus scrofa__NP_999071.1__HLA-A2-SP_SsAMEL(17-61) (opt12)

SEQ ID NO: 4848 - RNA, 590 nt, Artificial Sequence; identical to SEQ ID NO: 4388
  mRNA product Design3 comprising derived and/or modified sequence from Sus scrofa__NP_999071.1__HLA-A2-SP_SsAMEL(17-49,167-189) (opt12)

SEQ ID NO: 4849 - RNA, 881 nt, Artificial Sequence
  mRNA product Design3 comprising derived and/or modified sequence from Sus scrofa__P45561-2__SsAMELX-001-2 (opt12)
gggagagucccgcagucggcguccagcggcucugcuuguucgugugugugucguugcaggccuuauucaagcuuaccaugggaacauggauauuauucgcaugccuacuaggagcagccuucucaaugccacuaccaccacacccaggacacccaggauacauaaacuucucauacauaagacauccauacacaucauacggauaugaaccaaugggaggauggcuacaccaccaaauaauaccaguaguaucacaacaaaccccacaaucacacgcacuacaaccacaccaccacauaccaaugguaccagcacaacaaccaggaauaccacaacaaccaaugaugccauuaccaggacaacacuccaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccccaaccaccacuaccaccaauguucucaaugcaaucacuacuaccagaccuaccacuagaagcauggccagccacagacaaaacaaaacgagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4850 - RNA, 917 nt, Artificial Sequence
  mRNA product Design3 comprising derived and/or modified sequence from Sus scrofa__NP_998965.1__SsAMELX-001-3 (opt12)
gggagagucccgcagucggcguccagcggcucugcuuguucgugugugugucguugcaggccuuauucaagcuuaccaugggaacauggauauucuucgcaugcuuacuaggagcauccuuagcaaugccacuaccaccacacccaggccacccaggauacauaaacuucucauacgaaguacuaacaccacuaaaaugguaccaaaacaugauaagacacccauacacaucauacggcuacgaaccaaugggcggcuggcuacaccaccaaauuauaccaguaguaucacaacaaacaccacaaucacacgcacuacaaccccaccaccacauaccaaugguaccagcacaacaacccggaauaccacaacaaccaaugaugccacucccaggacaacacucaaugacaccaacacaacaccaccaaccaaaccucccacuaccagcacaacaaccauuccaaccccaaccaguacaaccacaaccacaccaaccacuacaaccacaaucaccuaugcacccaauacaaccauuacuaccccaaccaccacuaccaccaauguucucaaugcaaucacuacuaccagaccuaccacuagaagcauggccagcaacagacaaaacaaaaagagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4851 - RNA, 566 nt, Artificial Sequence; identical to SEQ ID NO: 4391
  mRNA product Design3 comprising derived and/or modified sequence from Sus scrofa__K7GPB2__SsAMELX-002 (opt12)

SEQ ID NO: 4852 - RNA, 959 nt, Artificial Sequence
  mRNA product Design3 comprising derived and/or modified sequence from Sus scrofa__K7GLD0__SsAMELX-003 (opt12)
gggagagucccgcagucggcguccagcggcucugcuuguucgugugugugucguugcaggccuuauucaagcuuaccaugggaacauggauacuauucgcaugccuacuaggcgcagcauucucaaugccacuaccaccacaccccggacacccaggcuacauaaacuucucauacgaagauuuauacuuagaagcaauaagaauagacagaacagcauuuguauuaacaccacuaaaaugguaccaaaacaugauaagacacccauacacaucauauggauacgaacccaugggaggauggcuacaccaccaaauaaucccaguaguaucacaacaaacaccacaaucacacgcccuacaaccacaccaccacauaccaaugguaccagcacaacaaccaggaauaccacaacaacccaugaugccacuaccaggacaacacucaaugacaccaacacaacaccaccaacccaaccuaccacuaccagcacaacaaccauuccaaccacaaccaguacaaccacaaccacaccaaccauuacaaccacaaucaccaaugcacccaauacaaccccuacuaccacaaccaccacuaccaccaauguucucaaugcaaucacuacuaccagaccuaccacuagaagccuggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4853 - RNA, 845 nt, Artificial Sequence
  mRNA product Design3 comprising derived and/or modified sequence from Sus scrofa__K7GPE9__SsAMELX-004 (opt12)
gggagagucccgcagucggcguccagcggcucugcuuguucgugugugugucguugcaggccuuauucaagcuuaccaugggaacauggauacuauucgcaugccuacuaggagcagcauucucaaugccacucccaccacacccaggacacccaggauacauaaacuucucauacgaaguacuaacaccacuaaaaugguaccaaaacaugauaagacacccaacaccacaaucacacgcacuccaaccacaccaccacauaccaaugguaccagcacaacaacccggaauaccacaacaaccaaugaugccacuaccaggacaacacuccaugacaccaacacaacaccaccaaccaaaccucccacuaccagcacaacaaccauuccaaccacaaccaguacaaccacaaccacaccaaccacuacaaccacaaucacccaugcacccaauacaaccacuacucccacaaccaccacuaccaccaauguucucaaugcaaucacuacuaccagaccucccacucgaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4854 - RNA, 869 nt, Artificial Sequence
  mRNA product Design3 comprising derived and/or modified sequence from Sus scrofa__J9JIM4__SsAMELX-201 (opt12)
gggagagucccgcagucggcguccagcggcucugcuuguucgugugugugucguugcaggccuuauucaagcuuaccaugccacucccaccacacccaggacacccaggauacauaaacuucucauacgaaguacucacaccccuaaaaugguaccaaaacaugauaagacaccccuacacaucauacggauacgaacccaugggaggauggcuacaccaccaaauaauaccaguagucucacaacaaacaccacaaucacacgcacuccaaccacaccaccacaucccaaugguaccagcacaacaaccaggaauaccacaacaaccaaugaugccacuaccaggacaacacucaaugacaccaacacaacaccaccaaccaaaccuaccacuacccgcccaacaaccauuccaaccccaaccaguacaaccacaaccacaccaaccacuccaaccacaaucaccaaugcacccaauacaaccacuacuaccacaaccaccacucccaccaauguucucaaugcaaucacuacucccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4855 - RNA, 3308 nt, Artificial Sequence
  mRNA product Design3 comprising derived and/or modified sequence from Homo sapiens__NP_006120.1__HsBMP1 (opt12)
gggagagucccgcagucggcguccagcggcucugcuuguucgugugugugucguugcaggccuuauucaagcuuaccaugccugggguugcaagacuaccguuacuauugggauuacuacuauuaccaaggccaggaagaccauuagauuuagcagauuauacguaugauuuagcagaagaagacgauagugaaccauuaaauuauaaagauccauguaaagcagccgcguuuuuaggggacauagcacuagaugaagaagaucuaagagcauuucaaguacaacaagcaguugaccuaagaagacacacagcuagaaaaucaucaauuaaagccgcugucccgggaaauacgaguacaccgaguugucaaucuacuaacggacagccacaacguggugcaugcggaagauggagaggacgcucaaggagucggagagcggcaacaagcagaccagaaagggucuggccagauggaguaauaccuuucguaauaggaggaaauuuuacaggaagucaaagagcaguauuccgucaagcuaugagacauugggaaaaacauaccuguguaacguuuuuagaaagaacagaugaagauaguuacauaguguuuacguaucgaccaugcggauguuguucuuacguaggaagacgagggggugguccccaagcaauaucaauagguaaaaacugcgauaaauucgggauaguaguacaugaacuagggcauguaguuggauuuuggcaugaacacacacgacccgauagagauagacaugucucaauaguaagggaaaacauacaacccggacaagaauauaauuucuuaaaaauggaaccacaagaaguugaaaguuuaggugaaacguaugacuucgauaguauuaugcauuaugcacgaaauaccuuuaguagaggaauuuuucuugacacuauaguaccgaaauaugaaguaaaugguguaaaaccaccaauaggucaaagaacaagauuaucaaaaggagauauagcacaagcucgaaaacuguacaaaugcccagcuuguggugaaacauugcaagauucaacaggaaauuucaguagcccagaauacccaaacggauauagugcgcauaugcauugcgucuggaggauuaguguaacaccaggugagaaaauaauacuaaauuuuacgaguuuagacuuauaucgaagcagauuauguugguaugacuauguugaaguuagagauggauuuuggagaaaagcaccauuaagaggaagauuuuguggaucaaaacuaccagaaccaauaguaaguacagauaguaggcuuuggguagaguucagaagcucgaguaauuggguaggcaaaggauucuuugcagucuaugaagccauauguggaggggauguuaagaaagacuauggacacauacaaucaccuaauuauccggacgauuaccgaccaagcaaaguuuguauuuggcggauucaaguaagcgaagguuuccacguaggacuuacauuccaaucuuuugaaauugaacgccaugauaguugcgcauacgacuaucuagaaguaagagauggucauagcgaaaguucaacacuaauuggaagauacugcggauaugaaaaaccugacgauauaaaaucaacaagcagucgauuauggcuaaaauuugugagugacggaagcauaaauaaagcuggcuucgcuguaaacuuuuucaaagaaguagaugaauguaguagaccaaauaggggcggaugugaacaacguuguuuaaauacuuuaggcucguauaaaugcagcugugaucccggauaugaacucgcaccagauaaaagaagaugugaagcagcauguggaggauuuuugacaaaacuuaaugguuccauaaccaguccaggguggccaaaagaauauccgccaaauaaaaauugcauuuggcagcuaguagcuccaacucaauaccguaucaguuuacaauucgacuucuuugaaacagaaggcaaugacguaugcaaauacgauuuuguagaaguuagaucugggcuaaccgcugacaguaaauuacauggaaaauuuuguggcucagaaaaaccagaaguaaucacaucacaauacaauaacaugagagucgaguuuaaaagcgauaacacaguuaguaagaaagguuuuaaagcccauuucuuuagugauaaagaugaaugcucaaaagauaauggagggugucaacaagauugcguaaauacauuuggaagcuacgaaugccaauguagauccggauuuguacuccaugauaauaaacacgauuguaaagaagcaggaugugaccacaaaguaaccucuacaucggggacuaucacgaguccaaacuggccagauaaauacccuucaaagaaagaaugcacuugggcgaucaguucuacuccaggacauaggguuaaauuaacauuuauggaaauggacauagaaucacaaccugaaugugcuuaugaccauuuagaaguuuuugauggaagagaugcuaaagcgccuguuuuaggucgguuuugcggaaguaaaaagccugaaccugucuuagccacuggcucaaggauguuuuuaagguuuuauucagacaacucaguccaaagaaaaggauuucaagcaagucaugcgacagaaugcggaggccaaguacgagcagauguaaaaacaaaagaucuuuauucucaugcacaauuuggugauaauaauuauccuggaggaguugauugugaguggguaauaguagcagaagaagguuauggaguugaauuaguauuucaaacguuugaaguagaagaagaaaccgauugcgguuaugacuacauggaacuauucgaugguuaugauucaacagcuccuagauuaggaagauauugugggucaggcccgccagaggaaguauauagugcaggagauagcguucuaguaaaauuucacagcgacgacacaauaaccaagaaaggauuccaucuacgcuauacaucaacuaaauuccaagauacacuacauagcagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4856 - RNA, 1538 nt, Artificial Sequence
  mRNA product Design3 comprising derived and/or modified sequence from Homo sapiens__NP_001191.1__HsBMP2 (opt12)
gggagagucccgcagucggcguccagcggcucugcuuguucgugugugugucguugcaggccuuauucaagcuuaccauggucgcaggaacaagaugucuacuagcacuauuacuuccacaaguucuacuaggaggagcagcuggauuaguaccagaauuaggaagaagaaaauuugcggcagcaucaucuggaagacccaguucacaaccaucagacgaaguauuaucagaauuugaacuuagacuacuuagcauguucggauuaaaacaacgucccacaccaucuagagaugcaguaguaccacccuauaugcuugaccuauacagacgucacagcggccaaccaggaucaccagcaccagaccauagacuagaaagagccgcaucaagagcaaacacaguaagaucauuccaccaugaagaaagcuuagaagaauuaccagaaacaucagguaaaacuacaagaagguuuuucuuuaacuuaagcucuauaccaacagaagaauuuauaacaucagcagaauuacaaguauucagagaacaaaugcaagacgcacuaggcaauaauagcagcuuucaccacagaauaaauauauaugaaauuauaaaaccagcaacagcaaacucaaaauuuccaguaacaagacuauuagacacacgacuaguaaaucaaaaugcaucaagaugggaauccuucgacguaacaccagcaguaaugagauggacagcacaaggacacgcaaaccauggauuuguaguagaaguagcucacuuagaagaaaaacaaggaguaaguaaacgucauguaagaauuagcagaaguuuacaucaagacgaacauuccuggucucaaauuagaccacuacuaguaacauucggacaugacggaaaaggacacccacuacacaaaagagaaaaacgacaagcaaaacauaaacaacguaaaagauuaaaauccucauguaaaagacauccauuauacguagauuucucagacguaggauggaacgacuggauaguagcaccacccggauaccacgcuuucuauugccauggagaaugcccauucccacuugcagaccaucuaaacagcacaaaucacgccauuguacaaacauuaguaaacagcguaaacuccaaaauaccaaaagcaugcugcguuccaacagaauuaagcgcaauaucaauguuauacuuagacgaaaaugaaaaaguaguacuaaaaaauuaccaagacaugguaguagaaggcuguggaugccgcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4857 - RNA, 1574 nt, Artificial Sequence
  mRNA product Design3 comprising derived and/or modified sequence from Homo sapiens__NP_001193.2__HsBMP4 (opt12)
gggagagucccgcagucggcguccagcggcucugcuuguucgugugugugucguugcaggccuuauucaagcuuaccaugauaccaggaaauagaaugcuuaugguaguauuacuaugccaaguauuacuaggaggugcaucccaugccucauuaauaccagaaaccggcaaaaaaaaaguagcugaaauacaaggacaugcaggaggaagaagauccggacaaucacacgagcuacuaagagacuuugaagcuacauuauuacaaauguuuggauuacgaagaagaccacaaccuucaaaaucagcugucauuccagauuauaugagagacuuauauagauuacaaucuggugaagaagaagaagaacaaauccacucaacuggacuggaauauccagaaagaccagcuucaagagcuaauacuguucguucauuucaucacgaagaacauuuagaaaacauaccaggaacaagcgaaaauagugcauuuagauucuuauucaaccuauccagcauuccagaaaacgaaguaauaucaagugcagaauuaagauuauuucgugaacaaguagaucaaggaccagacugggaaagaggauuucacagaauuaacauauaugaaguuaugaaaccaccugcagaagucguaccaggucaccuaauaacaagauuauuagauacaagacuaguacaucauaacgucacaagaugggaaacuuuugacguaucaccagcaguauuacgauggacacgagaaaaacaaccaaauuacggucuagcaauagaaguaacacaccuacaucaaacaagaacccaccaaggacaacauguacgaauaucaagaucauuaccacaaggaagcggaaacugggcacaauuaagaccacuacuaguuacuuuuggacacgauggaagaggacacgcacuaacacggagaagaagagcaaaacguucaccaaaacaccauucucaaagagcaagaaaaaaaaauaaaaacugcagacgacauagcuuauauguagauuucucagauguaggguggaaugacuggauaguagcaccuccaggauaccaagcauuuuacugucacggugacuguccauuucccuuagccgaucacuuaaacucaacaaaucaugcaauaguacaaacacuaguaaacaguguaaacucaaguauaccuaaagcaugcugcguaccaacagaacuaucagcaauuucaauguuauaccuagacgaauaugacaaaguuguauuaaaaaauuaucaagaaaugguuguagaaggauguggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4858 - RNA, 1889 nt, Artificial Sequence
  mRNA product Design3 comprising derived and/or modified sequence from Homo sapiens__NP_001709.1__HsBMP6 (opt12)
gggagagucccgcagucggcguccagcggcucugcuuguucgugugugugucguugcaggccuuauucaagcuuaccaugccaggacuagguagaagggcccaauggcuauguuggugguggggucuauuauguucauguuguggacccccuccucuaagaccaccauuaccagcugcugcagcagcagcagccggcgggcaauuacuaggagauggaggcucgccaggaagaacagaacaaccaccaccaucaccacaaucaucaucagguuuccuauacagacgacuuaaaacacaagaaaaacgagaaaugcaaaaagaaauauuaucuguuuuaggucuaccacauagaccuagaccacuacauggccuacaacaaccucaaccuccagcccuucgccaacaagaagaacaacaacaacaacaacaauuaccaagaggugagccaccacccgguagauuaaaaucagcuccuuuauucauguuagauuuauacaacgcccuauccgccgauaaugaugaagauggagcaucagaaggcgagaggcaacaaucauggccgcaugaagcagcuucaucaucacaacgccgacaaccaccuccuggugcugcacauccauuaaaucguaaaagccuacuugcaccaggaucaggaucuggaggagccucaccacuaacaagcgcacaagauucagcauuucuaaaugacgcugauauggucaugaguuuuguaaaucuaguagaauacgauaaagaguucucuccaagacaaagacaucauaaagaauuuaaauuuaaucuaucucaaaucccagaaggagaaguaguaacagcggcagaauuuagaauauauaaagauuguguaaugggaucauucaaaaaucaaacuuuucuaauuucaauauaccaaguauuacaagaacaucaacaucgcgacucagaccucuuuuuacucgacacccgaguuguuugggcauccgaagaaggcuggcuagaauuugauauuacagcaacaucaaauuuauggguaguaaccccucaacauaacauggguuuacaauuaaguguaguaacaagagacggaguucacguccacccaagagcugcaggauuaguaggaagagauggaccauaugacaaacaaccauucaugguugcauucuuuaaaguuagugaaguucauguacgaacaacaagaucagcaaguucaagaagaagacaacaaucuagaaaccgaaguacacaaucacaagauguugcacgaguaucaucugccagugacuauaauucaucagaauuaaaaacagcauguagaaaacacgaauuauacguaucauuucaagauuuagguuggcaagacuggauaauagcaccaaaaggauacgcagcaaauuauugugacggcgaauguucauuuccuuuaaaugcacauaugaaugcaacaaaccaugcaauaguccaaacauuaguccacuuaaugaauccagaauacguaccaaaaccuuguugugccccaacaaaauuaaaugcaaucucaguacuauacuucgaugauaauucaaauguaauauuaaagaaauaccgaaauaugguaguaagagcuugcggcugucacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4859 - RNA, 1643 nt, Artificial Sequence
  mRNA product Design3 comprising derived and/or modified sequence from Homo sapiens__NP_001710.1__HsBMP7 (opt12)
gggagagucccgcagucggcguccagcggcucugcuuguucgugugugugucguugcaggccuuauucaagcuuaccaugcaugucagaucacuuagagcagcagccccacauucuuucguagcauuaugggcaccauuauucuuauuaagaagcgcacuagcagacuuuucauuagacaaugaaguacauaguagcuuuauacauagacgccuaagaucacaagaaagacgagaaaugcaaagagaaauccuaucaauauuaggauuaccacauagaccaagaccucaucuacaaggaaaacacaacuccgcuccaauguucauguuagaccuauauaacgcaauggcugucgaagaaggaggagguccaggaggacaagguuuuaguuaucccuacaaagcaguauuuagcacacaaggcccaccacucgcaagcuuacaagauucccauuuccuaacagaugccgauaugguuaugaguuucguuaaucuuguagaacacgauaaagaauucuuccacccuagauaucaccaucgagaguucagauucgaucuuucaaaaauaccagaaggagaagccguuaccgcagcagaauuuagaauauauaaagauuacauccgcgaacgauuugacaaugaaacauucagaauaucaguauaucaaguacuacaagaacaucuagggagagaaucagaucuauuuuuauuagacucuagaacacuaugggcaucagaagaaggaugguuaguuuucgauauaacagccacaagcaaucacuggguaguaaacccuagacacaacuuaggauuacaauuaagcguagaaacacucgacggccaaaguauaaaccccaaacuagcaggacuaauaggacgacacggcccacaaaacaaacaaccauuuauggucgccuuuuucaaagcuacagaaguacauuuccgaucaauacgaucuacaggauccaaacaaagaucacaaaacagaucuaaaacaccaaaaaaucaagaagcauuaagaauggccaauguagcagaaaauagcucaucagaucaacgacaagcaugcaaaaaacaugaacuauacgugaguuucagagaucucggauggcaagauuggauaauagcaccagaaggauaugcagccuauuauugugaaggugaaugugcauuuccacuaaauucuuacaugaaugcaaccaaucacgcaauaguucaaacacuaguacacuuuauaaacccagaaacaguaccaaaaccuuguugcgcaccaacacaauuaaacgcaaucucaguauuauacuucgaugauaguucuaacguaauauuaaaaaaauacagaaacaugguagucagagcaugcgguugucacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4860 - RNA, 647 nt, Artificial Sequence; identical to SEQ ID NO: 4400
  mRNA product Design3 comprising derived and/or modified sequence from Homo sapiens__NP_006264.2__HsCCL7 (opt12)

SEQ ID NO: 4861 - RNA, 3971 nt, Artificial Sequence
  mRNA product Design3 comprising derived and/or modified sequence from Homo sapiens__NP_001954.2__HsEGF (opt12)
gggagagucccgcagucggcguccagcggcucugcuuguucgugugugugucguugcaggccuuauucaagcuuaccaugcuacucacguugauaauauuauuaccaguaguaucaaaauucucuuuuguuagccuaagugccccacaacauuggucuuguccagaagggacguuagccgggaauggaaacaguacaugugugggaccugccccauuuuuaauauuuucacacggaaauuccaucuuuagaaucgauacugaagggacaaauuaugaacaauuaguuguagaugccgguguaucaguaaucauggacuuccauuauaaugaaaaacggauuuacuggguugaucucgaaagacaacuacuucaaagaguguuuuuaaaugggaguaggcaagaaagagucuguaauauugagaaaaauguaucaggaauggcuauaaauuggauaaacgaagagguaauauggucuaaucaacaagaagguauuauaacugugacugauaugaaaggaaauaacucacauauccuccuaucugcucuaaaauauccugcuaacguggcaguugauccagucgaacgauuuaucuuuuggucaucagaggucgcaggaucgcuauauagagcagacuuagaugguguaggaguaaaagcauuacuagaaaccagcgagaaaauaacugcaguaaguuuagauguacucgacaaaagauuauucuggauacaauacaauagagaaggaucaaauucacuaauauguucuugugacuaugauggcggaagcguccacauaucuaaacaccccacacaacauaauuuauuugcgaugaguuuauuuggugauagaauauuuuauaguacguggaaaaugaaaaccauauggauagcuaauaaacauacaggaaaagacaugguccgaauaaaccuacacucauccuuuguaccucuaggggaauugaaaguaguacauccacuagcacaaccaaaagcggaagacgacacaugggaaccggaacaaaaacucuguaaacucagaaaggguaauuguucgaguacuguauguggacaagaucuacaaagccauuuauguaugugcgcagaaggauaugcuuuaucaagagaucgaaaauauugcgaagaugucaaugagugugcauuuuggaaucauggauguacccuuggcugcaaaaauaccccaggcucauauuauugcacuuguccaguaggauuuguauuguuaccugauggaaagcgaugucaucaacuuguaaguuguccacgaaauguuagugaauguucacaugauugcguguuaacaucagaaggcccauuaugcuucugcccagaaggaucaguguuagaaagagauggcaaaacuugcaguggaugcaguagcccagacaaugguggauguagucaauuauguguuccguuauccccagugucgugggaaugugacuguuuuccaggauaugauuuacagcuagacgaaaaaucuugcgcagcaagcgguccacaacccuuuuuacuauuugcaaauucccaagacauucgucacaugcauuuugaugguacugauuaugguacauuauuaucacaacaaauggguaugguauaugcauuagaccaugauccugucgaaaacaaaauauauuucgcucauacagccuuaaaguggaucgaacgcgcuaacauggauggaagucaaagagaaaggcucauugaagaaggagucgauguacccgaaggcuuagcaguagacuggauaggccgccgauuuuauuggacagauagagguaaaagucuuauaggacguucagacuuaaauggaaaaagaaguaaaauuauaacaaaagaaaacauaucacaaccuaggggaauagcaguacauccaauggcaaaacgccucuuuuggacagauacaggcauaaauccuagaauugaaaguucuagcuuacagggacuaggccggcuaguaauugccucaucagaccuaauauggccaagugggauaaccauagauuuucucacggacaaauuguauuggugcgaugcaaaacagucaguaauagaaauggcuaaucucgaugguucaaagagaaggagauuaacacagaacgauguuggucacccauucgcaguagcaguauucgaggauuacgucugguuuucggauugggcaaugccaaguguaaugagaguaaacaaaagaacagguaaagauagaguacgauuacaaggauccauguuaaagcccuccucauuaguagucguucauccauuggcuaaaccaggagccgacccaugcuuauaccaaaauggugguugugaacacauuuguaagaaaagauuaggaacagccugguguucaugcagagaaggcuucaugaaagcaucagauggaaaaacaugccuagcauuagauggacaccaacuacuagcaggaggagaaguugaccucaaaaaccaaguaacgcccuuagauauauuaaguaaaacucgaguuagugaggacaacauaacagaaagucaacacauguuaguggcugaaauaaugguaagugaucaagacgauugugcaccaguaggauguucaauguaugcacgcuguaucucagaaggcgaagaugcaacuugccaaugccuaaaaggcuucgcgggcgauggaaaacuauguucagacauagaugaaugugaaauggguguuccuguaugucccccagcguccucaaaaugcauaaauaccgaaggcggcuauguaugucguuguucagaaggguaccaaggugauggaauccauuguuuagauauagacgaaugucaauuaggcgaacauaguuguggugagaacgcuucuugcaccaacacagaaggagguuacacauguaugugcgcagggaggcuaagugagccaggauuaauuuguccagauaguacaccaccuccccaccuaagagaggaugaucaucauuacucaguaagaaauucagauagugaauguccauuaucucacgaugguuacugccuacaugacgguguaugcauguauauagaagccuuagauaaauaugcuuguaacuguguagucggcuacauaggagaaaggugucaauauagggaccuaaaauggugggaauuacgacaugcuggccaugggcaacaacaaaaaguaauaguuguagcagucugugucguaguucuaguaaugcuccucuuacuaucccuauggggugcucauuauuaccgaacgcaaaaacuucugaguaaaaauccuaaaaauccauacgaagaaucaucaagagauguacgaucaaggagaccagccgauacagaagaugggaugucgucuugcccacagccaugguucguuguaauaaaagaacaccaagauuugaaaaacggaggucaaccugucgcaggagaggauggacaagcugcagaugguaguaugcaacccacaaguuggagacaagaaccccaauuaugcggaaugggaacggaacaagggugcuggauuccaguaucgagcgacaaagggucuugcccccaaguaauggaaagaucguuccauaugcccucauacggaacgcaaacuuuagaaggaggaguagagaaaccacauuccuuacuaagcgcaaauccauuauggcaacaacgagcuuuagauccaccacaucaaauggaauugacacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4862 - RNA, 857 nt, Artificial Sequence
  mRNA product Design3 comprising derived and/or modified sequence from Homo sapiens__NP_001423.1__HsEREG (opt12)
gggagagucccgcagucggcguccagcggcucugcuuguucgugugugugucguugcaggccuuauucaagcuuaccaugacagcaggaagaagaauggaaaugcuaugugcaggaagaguaccagcacuauuacuaugucuaggauuccaucuauuacaagcaguauuaaguacaacaguaauaccaagcuguauaccaggagaaagcucagacaauugcacagcauuaguacaaacagaagacaauccaagaguagcacaaguaagcauaacaaaaugcucaagugauaugaauggauauugcuuacacggacaauguauauaucuaguagacaugagccaaaacuauugcagaugcgaaguaggauacacgggaguaagaugugaacacuucuuucuaacaguacaucaaccacuaucaaaagaauacguagcauuaacaguaauauuaauaauacuauuucuaauaacaguaguaggaagcacauacuauuucuguagaugguacagaaacagaaaaucaaaagaaccaaaaaaagaauaugaaagaguaacaucaggagauccagaacuaccacaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4863 - RNA, 815 nt, Artificial Sequence
  mRNA product Design3 comprising derived and/or modified sequence from Homo sapiens__NP_000791.1__HsFGF1 (opt12)
gggagagucccgcagucggcguccagcggcucugcuuguucgugugugugucguugcaggccuuauucaagcuuaccauggcagaaggagaaauaacaacauucacagcacuaacagaaaaauucaaccuaccaccaggaaacuacaaaaaaccaaaacuacuauacugcucaaacggaggacacuucuuaagaauacuaccagacggaaccguagacggaacaagagacagaucagaccaacacauacaacuacaauuaucagcagaaucaguaggagaaguauacauaaaauccacagaaacaggacaauacuuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaucaugcaaaagaggaccaagaacacacuacggacaaaaagcaauacuauuccuaccccuaccaguauccucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4864 - RNA, 1214 nt, Artificial Sequence
  mRNA product Design3 comprising derived and/or modified sequence from Homo sapiens__NP_001997.5__HsFGF2 (opt12)
gggagagucccgcagucggcguccagcggcucugcuuguucgugugugugucguugcaggccuuauucaagcuuaccaugguaggggugggaggaggagacguagaagacguaacaccaagaccaggaggaugucaaauaaguggaagaggagcaagagguuguaauggaauaccaggagcggcagcaugggaagcagcauuaccgagaagaagaccgagaagacacccaaguguaaauccuagaucaagagcagcuggaagcccaagaacacgaggaagaagaacagaagaaaggccuaguggaaguagauuaggggacagaggaagaggaagagcauugccaggaggaagacuaggcggaagaggaagaggaagagcaccagaaagaguaggagguagaggaagaggaagaggaacagcagcaccaagagcagcaccagcagcaaggggaaguagaccaggaccagcgggaacaauggcagcaggaaguauaacaacacuuccagcauugccagaagauggaggaaguggcgcauuuccgccaggacauuuuaaagauccaaagagauuauacuguaaaaauggagguuuuuuuuuaagaauacauccagauggaagaguagauggaguaagagaaaaaagugauccacauauaaaauuacaauuacaagcagaagaaagaggaguaguaaguauaaaaggaguaugugcaaacagauauuuagcaaugaaagaagauggaagauuacuagcaaguaaauguguaacagaugaauguuuuuucuuugaaagauuagaaaguaauaauuauaauacguaccgaaguagaaaauauacaaguugguauguagcguuaaaaagaacaggacaauauaaauuaggaagcaaaacaggaccgggacaaaaagcaauauuauuuuuaccuaugagugcgaaaaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4865 - RNA, 932 nt, Artificial Sequence
  mRNA product Design3 comprising derived and/or modified sequence from Homo sapiens__NP_002000.1__HsFGF7 (opt12)
gggagagucccgcagucggcguccagcggcucugcuuguucgugugugugucguugcaggccuuauucaagcuuaccaugcacaaauggauacuaacauggauacuaccaacacuacuauacagaagcugcuuccacauaauaugcuuaguaggaacaauaagccuagcauguaacgauaugacaccagaacaaauggcaacaaauguaaacugcagcucacccgaaagacacacaagaucauacgacuacauggaaggcggagacauaagaguaagaagacuauucugcagaacacaaugguacuuacgaauagacaaaagaggaaaaguaaaaggaacacaagaaaugaaaaacaacuacaacauaauggaaauaagaacaguagcaguaggaauaguagcaauaaaaggaguagaaucagaauucuaccuagcaaugaacaaagaaggaaaacuauacgcaaaaaaagaaugcaacgaagacugcaacuucaaagaauuaauacuagaaaaccacuauaacacauacgcaagcgcaaaauggacacacaacggaggagaaauguucgucgcacuaaaccaaaaaggaauaccaguaagaggaaaaaaaacaaaaaaagaacaaaaaacagcacacuuccuaccaauggcaauaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4866 - RNA, 974 nt, Artificial Sequence
  mRNA product Design3 comprising derived and/or modified sequence from Homo sapiens__NP_001936.1__HsHBEGF (opt12)
gggagagucccgcagucggcguccagcggcucugcuuguucgugugugugucguugcaggccuuauucaagcuuaccaugaaacuacuaccaagcguaguacuaaaacuauucuuagcagcaguacuaagcgcacuaguaacaggagaaagccucgaaagacuacgaagaggccuagccgcagguacaucaaacccagacccaccaacaguaucaacagaccaauuacuaccacuaggaggaggaagagacagaaaaguaagagaccuucaagaagcagaccuagaucuacuaagaguuacauuaucaucaaaaccacaagcacuagcaacaccaaacaaagaagaacacggaaaaagaaaaaaaaaaggaaaaggacuaggcaaaaaaagagacccaugcuuaagaaaauacaaagacuucugcauacacggagaaugcaaauacguaaaagaacuaagagcaccaucaugcauaugccacccaggauaucacggagaaagaugccacggauuaagccuaccaguagaaaauagacuauacacauacgaccacacaacaauacuagcaguaguagcaguaguacuaucaucaguaugucuacuaguaauaguaggacuauuaauguucagauaccacagaagaggcggauacgacguagaaaacgaagaaaaaguaaaacuaggaaugacaaauucacacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4867 - RNA, 2534 nt, Artificial Sequence
  mRNA product Design3 comprising derived and/or modified sequence from Homo sapiens__NP_000592.3__HsHGF (opt12)
gggagagucccgcagucggcguccagcggcucugcuuguucgugugugugucguugcaggccuuauucaagcuuaccauguggguuacaaaacuauuacccgccuuacuauuacagcaugucuuacuacaucuauuacuauuacccauagcuauaccauaugcugaaggccaacguaaaagaagaaauacaauucaugaauuuaaaaaaucagcuaaaacaacauuaauaaaaauagacccagcuuugaaaauaaaaacaaaaaaaguaaacaccgcagaucaaugugcaaaucgauguacacgaaacaaaggauuacccuuuacauguaaagcauuuguauuugauaaagccagaaaacaaugcuugugguuuccuuucaacucaaugucaucaggaguaaaaaaagaauuuggccacgaauucgaucuauaugaaaauaaagauuauauaagaaauuguauaauaggaaaaggacgaucauauaaaggaacaguaaguauaacaaaaagcggaauaaaaugucaaccgugguccaguaugauaccacaugaacauucauuuuuaccaucaucauaccgagguaaagacuuacaagaaaauuacugcagaaauccacgaggagaagaaggaggaccauggugcuucacaucaaauccagaaguucgauaugaaguaugugacauuccucaauguucagaaguagaaugcaugacuuguaauggagaaucuuauagagguuuaauggaccauacagaaaguggaaaaauaugccaacgaugggaucaccaaacaccacauagacacaaauuccuaccagaaagauacccagacaaaggauuugaugauaacuacuguaggaacccggauggacaaccaaggccauggugcuauacauuagauccacauaccagaugggaauauugugcaauaaaaacuugugcagauaauacaaugaaugacaccgauguaccacuugaaaccacagaauguauacaaggucaaggagaaggauaucgaggaacaguaaauacaauauggaauggaauaccgugucaacgaugggauagucaauacccccaugaacaugacaugacaccagaaaauuuuaaaugcaaagaucuaagggaaaauuauuguaggaauccagauggaucagaaucaccuugguguuucaccacagauccaaauauacgcguuggauauuguucacaaauaccaaauugcgacaugagucacggacaggauugcuauagagguaauggaaaaaauuauaugggaaaccuaucacaaacaagaucaggucuaacaugcucaaugugggacaaaaacauggaagauuuacauaggcacaucuucugggaaccagaugcaagcaaauuaaaugaaaauuauugucgaaauccagaugacgacgcacauggaccaugguguuacacaggaaacccacuaauaccaugggacuauugccccauaucaagaugcgaaggagauacuacacccacuauaguaaaucuagaucacccuguaauaucaugugcaaagaccaaacaacucaggguaguaaacggcauaccaacucgaaccaauauuggauggaugguuucacuaagauaccgcaacaagcauauaugcggaggaagccuaauuaaagaaucauggguauugacagcaagacaauguuucccaagccgagaccuuaaagauuaugaagcaugguuaggaauacacgacguacauggcagaggagaugaaaaaugcaaacaaguacuuaacguuucucaauuagucuacggaccagaaggauccgacuuaguacuaaugaaauuagcaagaccagcaguucuagaugauuuuguaucuacaauagaucuaccaaacuacggauguacaauaccugaaaaaacaagcugcaguguauacggaugggguuauacuggccuuauaaauuaugacggacuccuaaggguagcucauuuauauauaaugggaaaugaaaaaugcucccaacaucaucguggaaaaguuacacuaaaugaaucagaaauaugcgcaggugcagaaaaaauagguucaggaccaugugagggagauuaugguggaccauuaguuugugaacaacauaaaaugcgaaugguccuaggaguaauuguaccaggaagaggaugcgcaauaccuaauagacccggaauuuucgucagaguagcauacuaugcuaaauggauacauaaaauaauacuaacguauaaagugccucaaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4868 - RNA, 2273 nt, Artificial Sequence
  mRNA product Design3 comprising derived and/or modified sequence from Homo sapiens__NP_005336.3 __HsHSPA1A (opt12)
gggagagucccgcagucggcguccagcggcucugcuuguucgugugugugucguugcaggccuuauucaagcuuaccauggcaaaagcagcagccauaggaauagaucuugguacaacauauucaugcguaggcguauuucaacauggaaaaguagaaauaauagcaaacgaccaaggcaaccgaacaacaccauccuacguggcuuucacagacacagaaagacuaauuggcgaugcagcuaaaaaucaaguugcauuaaauccacaaaacacaguauuugacgcaaaaagacucauaggaagaaaauuuggggauccuguaguccaaagcgauaugaaacacuggcccuuucaaguaauaaacgacggcgacaaaccaaagguacagguaaguuauaagggagaaacaaaagcauuuuaccccgaagaaaucagcagcaugguauuaacuaaaaugaaagaaauagccgaggcauauuuaggauauccaguuacaaacgcagucauaacuguaccagcauacuuuaaugauucacaaaggcaagcaacaaaagaugcaggaguaauagcuggauuaaacguauuaagaauaauaaacgaaccaacagcagcagcaauagcguaugguuuagaccgaacaggcaaaggagagagaaacguacuaaucuuugaucuaggaggaggaacauucgauguaucaauauuaacaaucgaugacggaauauucgaaguuaaagcaacugcaggagacacacacuuaggaggagaagauuuugauaacagauuaguaaaccacuuuguagaagaauuuaaacgaaaacauaagaaagacauuucacaaaauaaaagggcuguaagaagacuaagaacagcuugcgaaagagcuaaaagaacacuaagcagcucaacacaagcaagucuagaaauagacaguuuauuugaaggaaucgauuucuacacaucaauaacaagagcacgauuugaagaacuauguagugaccuauuuagaagcacucuagagccugucgaaaaagcauuaagagaugcuaaauuagacaaagcacaaauacacgaucuaguucuaguaggaggaucaacucgaauccccaaaguacaaaaacuauuacaagauuucuucaaugguagagaccucaauaaaaguauuaauccagaugaagcagucgcauauggugcugcaguacaggccgcaauuuuaaugggggauaaauccgaaaacguccaagaucuauuauuauuagacguagcaccauuaucacuagguuuagaaacagcuggagggguaaugacugcauuaauaaaaaggaacaguacaauaccgacaaaacaaacacaaauauuuacaacauacucagauaaucaaccaggaguuuuaauucaaguauacgagggagaacgcgcaaugacaaaagacaacaaucucuuaggccgguuugaacuaucagguauaccuccagccccuagagguguuccacaaauagaaguaacauuugauauugacgcuaaugguauccuaaacgucacagcaacugacaaaucaaccggaaaagcaaauaaaaucacaauaacaaaugauaagggaagacuuaguaaagaagaaaucgaaagaaugguacaagaggcagaaaaauauaaagcggaagacgaaguacaaagagaaagaguaagugcuaaaaacgcgcuugaauccuaugcauucaauaugaaaucagcagucgaggacgaaggauuaaaaggaaaaauaagugaagcagacaaaaagaaaguuuuagauaaaugccaagaaguuauuucaugguuagaugcaaauacauuagcagaaaaagacgaguucgaacauaaaaggaaagaacuagaacaaguauguaauccuauaauaagcggauuauaccaaggugcgggagguccaggacccggugguuucggugcucaaggaccuaaaggcggcaguggaaguggaccaacuauagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4869 - RNA, 2273 nt, Artificial Sequence
  mRNA product Design3 comprising derived and/or modified sequence from Homo sapiens__NP_005337.2 __HsHSPA1B (opt12)
gggagagucccgcagucggcguccagcggcucugcuuguucgugugugugucguugcaggccuuauucaagcuuaccauggcuaaagcagcagcaaucggaaucgauuuagggacaacauacagcuguguaggaguauuccaacacggaaaaguugaaauaauagcaaaugaucagggaaacaggacaacuccuagcuauguugcauuuaccgauaccgaacgucucauuggagaugcggcaaaaaaucagguagcauuaaacccccaaaacacaguauuugacgcuaaaagauuaauaggacgaaaauucggagauccgguuguacaaagcgacaugaaacacuggccauuucaaguaauaaaugauggagacaaaccaaaaguccaagucucuuacaaaggagaaacaaaagcauucuacccagaagaaauaucaaguauggucuuaaccaaaaugaaagaaauagcagaagcauacuuaggguacccaguaacaaaugcaguaauaacaguucccgcauauuuuaacgauagccaaagacaagcuacuaaagacgcaggaguaaucgcaggauuaaauguacuuagaauuauaaaugagccaacugcagcagcaauugcauauggauuggacaggacuggaaaaggagaaagaaacguauuaauauuugaccuaggaggaggcacauuugacguaucaauauuaaccauagacgacggaauauucgagguaaaagcaacagcaggagacacccauuuaggaggagaagauuucgauaaucgauuaguaaaucauuuuguagaagaauuuaaaagaaaacauaaaaaagauauaucacaaaauaaaagagcaguuagacgauuacgaacagcuugcgaaagagcaaaaagaacccuaaguucuagcacacaagcuagccuugaaauugauucccuauuugaaggcauagauuucuauacaagcaucacucgagcaagauuugaagaauuaugcagugacuuauuuagaucaacucuagaaccuguagaaaaagcgcuuagagacgccaaauuagauaaagcacaaauccaugauuuagucuuaguaggaggaucaaccagaauacccaaaguacaaaaacuauuacaagacuucuucaacggaagagaucuaaauaaaucaauaaauccugacgaggcaguugccuacggagccgcgguacaagcagcaauacuaaugggagacaaaagcgaaaacguacaagaucuauuacuucuagauguagcaccucuaaguuuaggauuagaaacagcaggaggaguaaugaccgcacuaauaaaaaggaauucaacgauaccaacaaaacaaacucaaauuuucacaacauacucagacaaucaaccuggaguacuaauacaaguauacgaaggagagagagcaaugacaaaagauaacaaucuauugggaagauucgaacuaucaggaauacccccggcgccacgaggaguaccgcaaauugaaguaacuuuugauauagaugccaauggaauauuaaauguaaccgcaaccgauaaaagcacuggaaaagcaaauaaaauaacaauaacaaaugacaaaggaagacuaucaaaagaagaaauagaacgaaugguccaagaagcagaaaaauacaaagcagaagacgaaguacaacgagaacgaguuucagccaaaaaugcauuagaaucauacgcauuuaacaugaaaagugcaguagaagacgaaggacuaaaaggaaaaaucucagaagcagauaaaaaaaaaguacuggauaaaugucaagaagucauaaguugguuagacgcaaauacauuagcagaaaaagacgaauucgaacacaaaagaaaagagcuagaacaagucuguaacccuauaauaaguggacuauaccaaggagcgggaggaccaggaccaggagguuuuggugcacaagguccaaaaggcggaagcggcagcggaccuacaauagaagaaguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4870 - RNA, 2273 nt, Artificial Sequence
  mRNA product Design3 comprising derived and/or modified sequence from Homo sapiens__NP_005518.3 __HsHSPA1L (opt12)
gggagagucccgcagucggcguccagcggcucugcuuguucgugugugugucguugcaggccuuauucaagcuuaccauggcuacagcaaaaggaauagcuauuggaauagaucuaggcacaacauacaguugcguuggcguuuuucagcauggaaaaguagaaauuauagcaaaugaucaaggaaaucgcaccacuccuucuuauguagcuuucacagauacagaacgacuuauaggagacgcugcuaaaaaccaaguugcaaugaacccacaaaauacugucuuugacgcaaaaagacuaauaggccgaaaauucaaugacccaguaguacaagcggacaugaaacuuuggccauuccaagugaucaacgaaggugguaaaccaaaaguauuaguaucauacaaaggagaaaauaaagcauuuuacccagaagaaauaagcucuaugguacugacuaaauuaaaagaaacagcagaagcauuucuaggacacccaguaacaaaugcaguaauaacaguacccgcuuacuuuaaugacucccaaagacaagcaacaaaggacgcaggaguuauagcaggacuuaauguacuuagaauaaucaacgaaccaacagcggcagcaauagccuauggauuagauaaaggaggacaaggagaacgacauguauuaauauuugaccuagguggagguacauucgaugucucuauauuaaccauagacgacggaauauucgaaguaaaagcaacagcaggggacacucauuuaggcggagaagauuuugacaauagauuaguaagccacuucguagaagaguucaaaagaaaacacaaaaaggauauaagucagaauaaacgagcaguaagaagacuacgaacagccugugaaagagcuaaaagaacguuaucaaguucaacacaagcaaaucuagaaauagacagucuauaugaaggaauagauuucuauaccucaauaacgagagcuagauuugaagaacuaugcgcagaucuauucagaggcacacuagaaccaguagaaaaagcucuacgagaugcaaaaauggacaaagcuaaaauucaugauauaguccuuguagggggaucaacaagaauaccaaaaguacaaagauuguuacaagauuacuuuaacggaagagauuuaaacaaaucaauaaacccagaugaagcuguagcauauggcgcagcaguacaagcagcaauacuuaugggagauaaaagugaaaaaguacaagauuuauuauuauuagacguagcaccacuaucccuaggacuagaaacagcaggaggaguaaugacagcacucauaaaaagaaauaguaccauaccaacaaaacaaacccaaauauuuacaacguauagcgacaaucaaccaggaguacuaauacaaguguaugaaggagaaagagcaaugaccaaagauaauaaucuucuuggccgauucgaucucacaggaauaccuccagcaccaagaggagucccacaaauugaaguuacauuugacauagacgccaaugguauacuaaacguaacagcuaccgauaaaaguacaggaaaaguaaacaaaaucacaaucacaaaugacaaagguagauuaucaaaagaggaaaucgaaagaaugguauuggacgcagaaaaauauaaagcagaagacgaaguacaaagagagaaaauagcagcuaaaaacgcucuugaaucauaugcauuuaacaugaaaucaguaguauccgacgaaggacucaaaggaaaaauaagcgaaucagauaaaaauaaaauacucgauaaaugcaacgaacuauuaagcugguuagaaguaaaucaacuagcagaaaaagaugaauuugaccauaaaagaaaagaacuagaacaaauguguaauccaauaauaacuaaauuauaccaaggaggaugcacaggaccagccuguggcacaggauauguuccuggacgacccgcaacuggaccaacaauagaagaaguugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4871 - RNA, 2267 nt, Artificial Sequence
  mRNA product Design3 comprising derived and/or modified sequence from Homo sapiens__NP_068814.2 __HsHSPA2 (opt12)
gggagagucccgcagucggcguccagcggcucugcuuguucgugugugugucguugcaggccuuauucaagcuuaccaugagcgcaagaggaccagcgauuggaaucgaucuaggaacaacguacaguugcgugggaguauuccaacauggaaaaguugaaauaaucgcaaaugaucagggaaauagaacuacaccaucauacguugcuuuuacagacaccgaaagauugauuggagacgcagcgaaaaaucaaguagcaaugaauccaaccaacacaaucuuugacgcaaaaagacucauaggcagaaaauucgaagacgcaacgguacagagcgauaugaaacacuggccauuuagaguaguaucagaaggaggaaaaccaaaaguacaagucgaauauaaaggagaaacuaaaacauuuuucccagaagaaauaagcaguaugguauuaacaaaaaugaaagaaauagcagaagcauaucuaggaggaaaaguucauagugcaguaauaacuguaccagcauauuuuaaugauucacaaagacaagccacgaaagaugccggaacaauaaccggauuaaauguacugagaauaauaaacgaaccaacagcugccgcaauagcauacgggcuagauaagaaaggaugugccggaggugagaaaaauguauuaauauuugacuuaggcggaggaacauuugauguaucaauacuaacaauugaagacggaauauucgaaguuaaaaguacggcgggagauacacauuuaggaggagaagauuuugauaacagaaugguaagucauuuagcagaagaguucaaacgaaaacacaagaaagacauaggaccuaauaaaagagcaguaagaagacuaaggacugcaugcgaaagagcaaaaagaacacuaaguagcaguacacaggcgaguauagaaauagacucauuauaugaaggagucgauuuuuauacuucaauaacgagagcaagauucgaagaacucaaugcggauuuauuuagaggaacauuggaaccaguagaaaaagcacuuagagaugcaaaacuagacaaaggacaaauccaagaaauaguccuaguagguggcucaacaagaauaccaaaaauccaaaaacuauugcaagauuucuucaauggcaaagaauuaaauaagucaaucaauccagacgaagcagucgcauacggagcagcaguucaagcagcaauauugauaggggauaaaucagaaaauguacaagaccuauuauuguuagauguaacaccauuaagucucgguauagaaacugcaggaggaguaaugacaccucuaauaaaaagaaacacaacuauaccaacaaaacaaacacaaacauuuacaacauacagugacaaucaaucaaguguauuaguacaaguauacgaaggagaaagagcaaugacgaaagacaacaaucuauuaggaaaauuugaucuaacagggauuccuccagcaccgagagguguaccacaaaucgaaguaacauuugacauagacgcaaauggaauauuaaacguaacagcagcagauaaaucaaccgggaaagaaaacaaaaucacaauaacuaacgauaaagggagguuaagcaaagaugauaucgaucguaugguccaagaagcagaaagauauaaaagcgaggaugaggcaaacagagacagaguagcagcgaaaaaugcauuagaaucuuacacguauaauauaaaacaaacuguagaggacgaaaaauuacggggaaaaauauccgaacaagauaaaaacaaaauauuagauaaaugccaagaagucauaaacugguuagacagaaaucaaauggcagaaaaagaugaauacgaacauaaacagaaagaacuagaaagaguguguaaucccauaauaucaaaauuauaccaaggagguccaggagguggaagcgggggaggaggaaguggcgcaagcggagggccaacaauagaagaaguagauuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4872 - RNA, 2870 nt, Artificial Sequence
  mRNA product Design3 comprising derived and/or modified sequence from Homo sapiens__NP_002145.3 __HsHSPA4 (opt12)
gggagagucccgcagucggcguccagcggcucugcuuguucgugugugugucguugcaggccuuauucaagcuuaccaugucuguaguaggaauagaccucggauuucaaaguuguuauguagcagucgcucgggcaggaggcauugaaacaauugcaaaugaauacucagacagguguacaccagcaugcauaaguuucggaccaaaaaaccgaucaauaggcgcagcagcaaaaagccagguaauaucaaaugcuaaaaauacaguacaaggguuuaaaagauuccacggaagagcauuuucagauccuuuuguagaagcugaaaaaaguaauuuagccuacgacauaguucaguuaccaacaggauuaacaggcauaaaaguaacuuauauggaagaagaacgaaacuuuacaacugaacaaguaacagcaaugcuacuaucuaaauuaaaagaaacugcagaaaguguuuuaaaaaaaccaguaguagacuguguaguaagcgugccauguuuuuauacagacgcggaaagaagaucggucauggaugcaacacaaauagcagggcucaauugccuuaggcucaugaaugaaacaacugcaguagcucuagcuuacggaauuuauaaacaagacuugccagcacuagaagagaaaccaagaaacgucguuuucgucgauaugggacacucagcauaccaaguaaguguuugcgcauuuaauagaggaaaacuaaaaguauuggcaacagcauuugacacaacacuaggagguagaaaauucgaugaaguacuagucaaucacuuuugugaagaauucggaaaaaaguacaaacuagauauuaaaucaaaaauuagagcauuauugcgacuaagccaagaaugugaaaaacuaaaaaaauuaaugucagcaaaugcaucugacuuaccauuaagcauugaaugcuuuaugaaugauguagaugucucaggaacaaugaaucgaggaaaauucuuagaaauguguaacgaucuacuagcuagagucgaacccccucucaggucagugcuagaacaaacaaaacuaaaaaaagaagauauauacgccguggaaaucguagguggagcuaccagaauaccagcugugaaagagaaaauaaguaaauucuucggcaaagaauuaucaacaacacuaaaugcagacgaagcaguuacccgaggaugugcuuuacaaugugcaauuuuaucgccagcauucaaaguacgagaauucucaauaacagauguaguaccuuaucccauaucucuuagauggaauucaccagcagaagagggaagcucagauugcgaaguauuuucaaaaaaccacgcugcaccguuuuccaaaguacugacuuucuacagaaaagaaccauuuacguuagaagcauacuauucaucuccccaagacuuaccauacccagaucccgccauugcacaauucucaguacaaaaggugaccccacaauccgacggauccagcucaaaagugaaaguaaagguaagaguaaauguacacggcauauuuucaguaaguucagcgucccucguagaaguucacaaaagcgaagaaaacgaagaaccaauggaaacagaccaaaacgcaaaagaagaagaaaaaaugcaaguagaccaagaagaaccccauguagaagaacaacaacaacaaacacccgcagaaaacaaagccgaaagugaagaaauggaaacaucacaagcaggcaguaaagauaagaaaauggaucaaccaccacaggcaaaaaaagcuaaaguaaaaacaaguacaguagaucucccaauugaaaaucaacuacuauggcaaaucgauagagagauguuaaaccuauacaucgaaaaugaaggaaaaaugaucaugcaagacaaacuagaaaaagaacggaacgaugcaaaaaacgcaguggaagaguauguauaugaaaugcgagacaaacuaucaggagaauaugaaaaauuuguuagcgaggaugacagaaauucauucaccuuaaaacuagaagauacugaaaauugguuauaugaagacggagaagaccaaccuaagcaaguguacguugauaagcuagcagagcucaaaaauuugggccagccaauaaaaauaagauuccaagaauccgaagaaagaccgaaacuauucgaagaacuugggaaacaaauacagcaauacaugaagauaaucucaucauuuaaaaacaaagaagaucaauacgaccacuuagacgcagcagacaugacuaaaguagaaaaaucuacgaacgaagcaauggaauggaugaauaacaaacuaaaucuucaaaacaaacaaucacuuacaauggacccaguaguaaaaagcaaagaaaucgaagcgaaaauaaaagaauuaacgagcacauguucaccuauaauaucaaaaccaaaaccaaaaguggaaccaccuaaagaagaacaaaaaaaugcagaacaaaauggaccgguagacgggcaaggagacaauccaggaccucaagcagccgaacagggcacagacacagcaguaccaucagacagcgacaaaaaacuaccggaaauggacauagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4873 - RNA, 2867 nt, Artificial Sequence
  mRNA product Design3 comprising derived and/or modified sequence from Homo sapiens__NP_055093.2 __HsHSPA4L (opt12)
gggagagucccgcagucggcguccagcggcucugcuuguucgugugugugucguugcaggccuuauucaagcuuaccaugagugugguaggaauagaccuuggauuccuaaauugcuacauagcuguagcaagaucaggaggcauugaaacaauagcaaacgaauauagcgaccgaugcacaccagcaugcauaucauuaggaaguaggacuagagccauagguaaugcggcaaaaucacaaauaguaaccaauguaagaaacaccauacauggauucaagaaacuacacggacgcagcuucgacgauccaauaguacaaacagaaagaauuagacuacccuacgaacuacagaaaaugccaaacggaucugcaggagucaaaguaagauaccuugaagaagaacggccauuugcaauugaacaagugacaggaauguuacuugcaaaacuaaaagaaacaagugaaaaugcauuaaagaaaccaguagcagauugcguaauuucaauacccagcuucuucacagacgcagaaagaagaaguguaauggcagcagcacaaguagccggacuaaacugucuaagacuaaugaacgaaacaacagcuguagcuuuagcauacggcauauauaaacaagaucuaccaccacuagaugaaaaaccaagaaacguaguuuuuauagauaugggacacucagccuaccaaguccuaguaugugcuuucaacaaaggaaaauuaaaaguacuugcaacaacauuugauccauaucuaggggguagaaauuucgacgaagcucuaguagacuacuuuugugaugaguucaaaacaaaauacaaaauuaaugucaaagaaaauucaagagcauuacucagacuuuaccaagaaugcgaaaaauuaaagaaacuaaugucugcaaaugcauccgauuuaccgcuaaauaucgaaugcuuuaugaaugaucuugacguaucaagcaaaaugaacagagcacaauuugaacaacuaugugcauccuuauuagcaagaguagaaccuccccuaaaagcgguaauggaacaagcuaaucuccaacgcgaagacauaagcucaauagaaauaguaggcggagcaaccagaauaccggcagugaaagaacaaauaacaaaauuuuucuuaaaagacauuucuacaacuuuaaacgcagacgaagcuguggcuagagguugcgcacuucaaugcgccaucuuaucaccagcguucaaaguccgcgaguucaguauaacagaccugguaccauacaguaucacgcuccgauggaaaacuagcuuugaagacggcucuggggaaugcgaaguauucuguaaaaaucacccagcaccauuuagcaaaguaauaacauuucacaagaaagaaccauucgaacuagaagcauucuacacaaacuuacaugaaguucccuacccagaugcacgaauagguaguuucacaauacaaaauguauucccacaauccgacggagacucaucuaaagucaaagucaaagugcggguaaacauacauggaauauucuccguugcaagugcaagugugauagaaaaacaaaaccucgaaggggaucauucagacgcaccuauggaaacggaaacaaguuucaaaaacgaaaacaaagauaauauggacaaaaugcaaguagaucaagaagaaggacaccaaaaaugccaugcggaacauacucccgaagaagaaauagaucauacaggugcuaaaacaaaaucagcaguauccgacaaacaagacaggcuaaaucaaacacucaagaaaggaaaaguaaaaaguauagaccugccgauacaaagcagucucugucgacaauuaggacaagauuuacuaaauaguuacauagaaaaugaagggaaaaugauuaugcaagauaaauuagaaaaagaaaggaacgaugccaaaaaugcuguugaagaauacguauaugacuuucgcgacagauuaggaacaguauacgaaaaauuuauaacccccgaagaccuaaguaaacuaucugcaguacuagaagacacagaaaauugguuauaugaagauggagaagaucagccaaaacaaguuuacguagauaaacuacaagagcuuaagaaauacggacaaccaauucaaaugaaauauauggaacaugaagaacgcccgaaagcauuaaacgacuuaggaaagaaaauacaauuaguaaugaaaguaauagaggccuacagaaacaaagaugaaagguaugaccaccucgaucccacagaaauggaaaaaguugaaaaaugcauaucagacgcuaugucauggcuaaacagcaaaaugaacgcccaaaacaaauuaucacuuacucaggauccuguaguaaaaguaagcgaaauaguagcgaaaagcaaagaacuagacaacuuuuguaacccuauaaucuauaaaccuaaacccaaagcagaaguaccagaggauaaacccaaagccaauucugaacauaaugggccaauggauggacaauccggcacagaaacaaaaucggacaguaccaaagacucaucacagcacacaaaaagcaguggagaaauggaaguugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4874 - RNA, 2312 nt, Artificial Sequence
  mRNA product Design3 comprising derived and/or modified sequence from Homo sapiens__NP_005338.1__HsHSPA5 (opt12)
gggagagucccgcagucggcguccagcggcucugcuuguucgugugugugucguugcaggccuuauucaagcuuaccaugaaacucucacuaguagcagcgauguuauuacuuuuaagugcugcacgagcagaggaagaagauaaaaaagaagacguagguacaguaguagguauagaccuaggaacaacauacucauguguaggaguauucaagaauggacgaguagaaauuauagcaaaugaucaaggcaauagaauaacaccaaguuauguagcuuucacacccgaaggagaaagauuaauaggggacgcagcuaaaaaccaauuaacaagcaauccagagaacacaguauuugacgcaaaaagauuaaucggcagaacauggaaugaccccucuguacaacaagauauuaaauuucuaccguuuaaagugguagaaaaaaaaacaaaaccuuauauacaaguagacauaggaggaggacaaacgaaaacauucgcuccagaagaaauaagcgcaaugguuuuaacuaaaaugaaagaaacagcggaagcauauuuaggaaaaaaaguaacucacgcuguaguaacagucccagcauacuuuaacgaugcucaaagacaagccacaaaagaugcaggaacaauugcaggcuuaaauguaaugagaauaauaaaugaaccuacagcagccgcaauagcguacggacuagacaaaagagaaggcgaaaaaaacauacuaguauuugauuuaggaggaggaacauucgauguaagucuacuuacaauugacaacggagucuuugaaguaguagccacaaauggagauacgcaucuaggaggagaggacuucgaccaaaggguuauggaacacuucauaaaauuauacaaaaaaaaaacaggaaaagacguuagaaaagacaauagagccguacaaaaauuaagacgagagguagaaaaagcaaaaagagcauugucaagccaacaccaagcaagaauagaaauagaaucauuuuaugaaggagaggacuucagcgaaacacuuacaagagcaaaauuugaagaacugaauauggauuuauuuagaaguacaaugaaaccaguucaaaaagucuuagaagauagugauuuaaaaaaaagcgacauagaugaaauaguacucguaggaggaucaacaaggauaccaaaaauacaacaauuaguuaaagaguuuuuuaauggaaaagaaccaucacgaggaauaaauccagacgaagcaguagcauacggagcagcaguacaggcaggaguacuaagcggagaucaagauacaggagaucuagucuuacuagaugucugcccacuuacauuaggaaucgaaaccguaggagggguaaugacaaaacuaauaccacguaacacgguugugccaacaaaaaaaucacagauauucaguacagcgucagacaaucagccaaccgucacuauaaaaguauacgaaggagaacgaccacuuacaaaagauaaccaucuacuaggaaccuucgauuuaacaggaauaccacccgccccaagaggaguaccacaaauagaaguuacauucgaaauagacguaaacgguauucuuagagugacagcugaagacaaaggaaccggaaauaaaaauaaaauaacaauaacuaacgaucaaaaccgacuaacuccagaagaaauagaacgcaugguaaacgaugcagaaaaauuugcagaagaagacaaaaaacuaaaagaacgaaucgauacuagaaaugaacuagaaucauacgcauauucauuaaaaaaucaaauaggcgacaaagaaaaacuaggaggaaaauuaucaagugaggauaaagaaacuauggaaaaagcggucgaagaaaaaauagagugguuagaaagucaucaagacgcugauauagaagauuuuaaagcaaaaaaaaaagaauuagaagagauaguacaaccaauaauaucaaaacuauauggaagcgccgguccuccaccaacaggcgaagaagacacagcugaaaaagacgaauuaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4875 - RNA, 2279 nt, Artificial Sequence
  mRNA product Design3 comprising derived and/or modified sequence from Homo sapiens__NP_002146.2__HsHSPA6 (opt12)
gggagagucccgcagucggcguccagcggcucugcuuguucgugugugugucguugcaggccuuauucaagcuuaccaugcaagccccaagagaauuagcaguuggaauagaccuagguacaacauacucauguguaggaguuuuucaacaaggaagaguugagauacuagcaaaugaucaaggaaacagaacaacacccagcuauguagcauucacugacacagaaagauuagucggagacgccgcaaaaucacaagcagcucuaaacccucauaauacaguuuuugaugcuaaaaggcuuauagggagaaaauucgcagacacaacaguacaaucagauaugaaacacuggcccuuucgaguaguaucagaaggaggaaaaccgaaaguaagaguuugcuauagaggagaagauaaaacauuuuacccagaagaaaucucaucaaugguucuuaguaagaugaaagagacagcggaagcauacuuaggacaaccggucaaacacgccguuauaacaguaccugcauauuucaaugacagucaaagacaagcuacaaaagaugcaggagcaauagcaggauuaaauguauuaagaauuauuaaugaaccaacagccgcagcaauagcauacggacuagaucguagaggagccggagaaagaaacgucuuaauauuugauuuaggagggggaacauuugauguaucaguucuaucgauagaugcaggaguauuugaaguaaaagcuacagcaggagauacacauuuaggcggggaagauuuugauaacagauuaguaaaucacuucauggaagaauuuagaagaaaacacgguaaggacuuaucaggaaauaaacgagcacucagaagacuuagaacagccugugaacgagcaaaacguacuuugagcucaaguacacaagcuacuuuagaaauagacaguuuauucgaagguguugauuuuuacacaaguauuacuagagcaagauuugaagaacuauguucagauuuauuucguucaacauuagaaccaguagaaaaagcacuaagagaugcaaaacuagauaaagcucaaauacaugauguggugcuaguaggagguuccacaaggaucccaaaaguccaaaaacuacuacaagauuucuuuaauggcaaagaacucaacaaaaguauaaaucccgaugaagcaguagcauauggugcagcaguacaagcagcaguuuuaaugggagauaagugugaaaaaguacaagauuuacuauuacuagacguagcaccccuaucacucggacuagaaacagcuggaggaguaaugacuacacuaauucaaagaaacgccacaaucccaacaaaacaaacacaaacauuuacaacauacucagauaaucaaccaggcguauuuauacagguuuacgaaggugaacgagcaaugaccaaagacaauaaucuacucgguagauucgaacuaaguggaauaccaccagccccaagaggaguaccacaaauagaaguaacauuugauauagaugcaaaugguauucucagcguaacugcaaccgaccguagcacaggaaaagcuaacaaaauaacuauaacgaaugauaaaggaagacuaaguaaagaagaaguagaacgcaugguacaugaagcagaacaauauaaagcagaagacgaagcacaaagagauagaguugcagcuaaaaacaguuuagaagcacauguguuccauguaaaaggaucauuacaagaagaaucauuaagagauaaaauuccagaagaagauagacgaaaaaugcaagauaaaugcagagaaguacucgcauggcuagagcacaaucaauuagcagagaaagaggaauaugaacaccagaaacgagaauuagaacaaauuugucgaccaauauuuaguagguuauacggaggaccaggagucccaggagguucaucauguggaacccaagcaagacaaggagaucccaguacagguccaauaauagaagaaguugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4876 - RNA, 1451 nt, Artificial Sequence
  mRNA product Design3 comprising derived and/or modified sequence from Homo sapiens__P48741__HsHSPA7 (opt12)
gggagagucccgcagucggcguccagcggcucugcuuguucgugugugugucguugcaggccuuauucaagcuuaccaugcaagcuccaagagaacuagcuguaggaauagauuuaggaacaacauauaguuguguaggaguauuucaacaaggaagaguugaaauacuagcaaaugaucaagggaauaggacaacaccaucauauguagcauuuacagauacagaacgauuaguaggagaugcagcaaaaucacaggcagcucuaaacccacauaauacaguauuugaugcaaaaagacuaauagguagaaaauuugcagacacuacaguacaaagcgauaugaaacauuggccauuucaaguaguaucagaagguggcaaaccaaaagucagaguauguuauagaggagaagauaaaacuuuuuaucccgaagaaauaucaucaaugguauuaaguaaaaugaaagaaacagcagaagcauaucuaggacaaccaguaaaacaugcgguaauaacaguuccaacauauuuuucaaacucacaaagacaagcaacaaaagaugccggugcaaucgcaggacuuaaaguauuaccaauaauuaaugaagcaacagcagcagcaauagcauauggacuagauagaagaggagcuggaaaaagaaauguauuaauauucgauuuaggagguggaaccuuugauguaucaguauuaagcauagaugcaggaguauuugaagucaaagcaacagcaggagauacacaucuaggaggggaagauuucgauaauagauuaguaaaucacuuuauggaagaguuuagaagaaaacauggaaaagauuuaagcgguaauaaaagagcauuaagaagacuaagaacagcaugcgaaagagcaaaaagaacaccaucaagcaguacgcaagcaacauuagaaauagacucauuauucgaaggaguagacuuuuauaaaucaauaacaagagcgagauucgaagaauuaugcucagacuuauucagaaguacacuagaaccaguagaaaaagcauuaagagaugcaaaacuugacaaagcacaaauacaugauuucguacuaggaggaggauuacacagucauccacaaggagcugaaguagcagcaggacuauuacaacgacaaggugcagaacaagaacaucaaccauagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4877 - RNA, 2288 nt, Artificial Sequence
  mRNA product Design3 comprising derived and/or modified sequence from Homo sapiens__NP_006588.1 __HsHSPA8 (opt12)
gggagagucccgcagucggcguccagcggcucugcuuguucgugugugugucguugcaggccuuauucaagcuuaccaugucaaaagguccggcaguaggaaucgauuuaggaacaacauauaguugugucggaguauuucaacauggaaaaguugaaauaauagcaaacgaucaaggcaauagaacuacaccaucuuacguugcauuuacagauacagaaagauuaauaggggacgcagcuaaaaaccaaguagcaaugaacccaacaaauacaguauuugacgcaaaacgacuaauaggaagaagauuugaugaugccguuguacaaucugacaugaaacauuggcccuuuaugguaguaaaugacgcaggaagaccaaaaguccaagucgaauacaaaggagaaacaaagagcuuuuacccugaagaaguuucuagcaugguccuaacaaaaaugaaagaaauugcagaagcguaccuaggcaaaaccguaacaaacgcagucgugacaguaccagcauauuuuaacgauucacaaagacaggcaacaaaagacgcaggaacaauugcaggacucaacguacuccgaauaauaaaugaaccaacugcugcagcaaucgcauauggguuagacaagaaaguaggagcagagcgcaauguacuaauauuugaccuaggaggagguacguucgauguaagcauauuaacaauagaagauggcauauuugaaguaaaauccacagcaggagacacacacuuaggaggagaagauuuugacaauagaauggucaaccauuucauugcagaguucaaaagaaaacacaagaaagauauuucagaaaauaaaagagcaguaagaagauuaagaacagcuugugaaagagcuaaaagaacuuuaucaucaucaacacaagcuagcauagaaauugacaguuuauaugaaggaauagauuucuauacauccaucacgcgagcaagguuugaagaauuaaaugcagacuuauuucgaggaacacuugacccuguugaaaaagcccuacgagacgcuaaacuagacaaaagccaaauacaugacauaguucuaguaggaggaagcacuagaauacccaaaauacaaaagcuacugcaagacuucuucaacggaaaggaacucaacaaaagcauuaaucccgaugaagcaguagcuuacggagcugcaguacaagcugcaauauuaaguggagacaaaagcgaaaacguacaagaucuacuauuacuagauguaacaccucuaagccucggaauagaaacggcaggaggagugaugacaguacucauaaaaagaaauacuacaauaccaaccaaacaaacacaaacauuuacaacauacucagacaaucaaccaggaguauuaauacaaguauacgaaggagaaagagccaugacaaaagacaauaaucuccuaggaaaauucgaauuaacaggaauaccaccagcaccucgcggaguaccacaaaucgaaguaaccuuugacauugaugcgaacggcauauuaaauguuucagccgucgacaagucuacaggaaaagagaacaagauaacaauaacuaaugauaaagggcgauuaagcaaagaagauauagaacgaaugguacaagaagcagaaaaauauaaagcagaagaugaaaaacaaagagauaaaguaucuagcaaaaauagccuagaaaguuaugcauucaauaugaaagccacaguugaagacgaaaaauuacaaggcaaaauaaaugacgaagauaaacagaaaauauuagacaaauguaacgaaauaauaaacuggcuggauaaaaaucaaacggccgaaaaagaagaauuugaacaucaacaaaaagaauuagaaaaaguaugcaauccgauaauaacaaaauuauaccaaucagcuggggguaugccaggggguaugccagguggauucccaggagggggagcaccaccaagcggaggagcaagcucaggaccaacaaucgaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4878 - RNA, 2387 nt, Artificial Sequence
  mRNA product Design3 comprising derived and/or modified sequence from Homo sapiens__NP_004125.3 __HsHSPA9 (opt12)
gggagagucccgcagucggcguccagcggcucugcuuguucgugugugugucguugcaggccuuauucaagcuuaccaugauauccgcaucaagagcagcagcggcaagauuaguaggagcagcagcaaguagaggaccaacagcagcaagacaccaagacaguuggaaugguuuaagccaugaagcauuuagacucgugaguaggagagauuaugcaagugaagccauaaaaggagcugugguaggaauagauuuaggaacaacuaauucauguguugcaguaauggaaggaaaacaggcuaaaguacuagagaaugcggaaggagcuagaaccacucccaguguaguagcauucacagcugauggagaaagauugguagggaugccggcaaaaagacaagcaguuacgaacccaaauaacacauuuuaugcaacaaaacgacuaauagggaggcgauacgaugacccggaaguucaaaaagauauuaaaaacguuccuuuuaagauaguaagagccagcaauggagaugccuggguagaagcccacggaaaguuauauucaccaagucaaauaggggcuuuuguacuaaugaaaaugaaagaaacagccgaaaauuacuuaggacauacugcuaaaaaugcaguuauaacaguaccagcauauuuuaaugauagccaaagacaagcuacaaaagaugcaggucagauaaguggucucaacguucugcgcguaauuaaugaaccaacagcugcugcacuagcauacggguuagauaaaagugaagauaaagucauagcgguauaugauuuaggaggaggcacauuugauauaucaauauuagaaauacaaaaagggguauucgaaguuaaaagcaccaauggagauacguuucuuggaggggaagauuuugaccaagcguuauuaagacauauagugaaagaauuuaagagagagacaggaguagaucuaacaaaagacaacauggcauuacaaagaguuagagaagcugcugagaaggcaaaaugugaauuaagcucaaguguacaaacagauauaaauuuacccuauuuaacaauggauagcaguggaccgaaacaucuaaauaugaaauugaccagagcucaauuugaaggaauagugacagauuuaauaaggagaacaauagcaccaugccagaaagcaaugcaagaugcagaggugaguaaaagcgauaucggagaagugauauugguaggaggaaugacaagaaugccaaaaguacaacaaacaguacaagacuuauuuggcagagcaccaagcaaagcuguuaacccagaugaagcaguggcuauuggagcagcuauacaaggaggaguguuagcaggagauguaacagauguauuauuacuagauguaacaccauuaucauuggguauagaaacacuaggagggguauuuacaaagcuaauaaauagaaauacaacaauaccaacaaagaagucucaaguauucucaacugcagcagaugggcaaacacaaguagaaauaaaaguaugucaaggagaaagagaaauggcaggcgacaauaaacuacuuggacaauuuacacuaauaggcauaccgcccgcccccaggggaguuccacaaauagaaguaaccuucgauauagaugccaacggaauaguacacguaagcgcaaaggacaaagggacagggagagaacaacaaauaguaauacaauccagcggagguuuaucaaaagacgacauagaaaacaugguuaaaaaugcagagaaguaugcagaagaagauagaagaaagaaagaaagaguagaagcaguaaauauggcagaggguauuauacaugauacggaaacaaaaauggaagaauuuaaagaucaauuaccugcagacgaaugcaauaaacuaaaagaagaaauaagcaaaaugagagaauuacuagcaagaaaagauucggaaacuggagaaaauauaagacaagcagcuaguagccugcagcaagccagcuuaaaacuauucgagauggcauauaagaaaauggcaagcgaaagagaaggcagugggagcucaggaacaggugaacaaaaagaagaccaaaaagaagaaaaacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4879 - RNA, 2375 nt, Artificial Sequence
  mRNA product Design3 comprising derived and/or modified sequence from Homo sapiens__NP_079291.2__HsHSPA12A (opt12)
gggagagucccgcagucggcguccagcggcucugcuuguucgugugugugucguugcaggccuuauucaagcuuaccauggcugauaaagaagcuggagguucugauggaccacgagaaacagcuccaacuucugcuuacucaaguccagcaaggucuuuaggagacacgggaauuaccccguuaagucccagucauauagucaacgauacugauucuaacguguccgaacaacaaagcuuucuuguaguaguagcaguugacuucggaacuacuucaucaggauaugcguauucauuuacaaaagaaccagaauguauccacgugaugagacgaugggaaggaggagaucccggaguaagcaaucaaaaaacaccgacaacaauacucuuaacaccagaacgaaaauuccauucauuuggcuacgcagcuagagauuucuaucaugaucuagauccaaaugaagcaaaacaaugguuauaucuugaaaaauuuaaaaugaaacuacauacaacaggugaccucacaauggauacugaucuaacagcagcaaaugggaagaaaguuaaagcacuagaaauauuugcauacgcccuucaauacuuuaaagaacaagcacuuaaagaacuaucagaucaagcaggaucugaauuugaaaauagcgauguuagauggguaauaacaguuccagcaauauggaaacaaccagcaaaacaauuuaugcgccaagcugcauaccaagcaggacucgccucuccagagaauucagaacaauuaauaauugcauuagaaccugaagcagccaguauauauugcagaaaacuaagauuacaucaaaugauugaauuaaguaguaaagcagcaguaaacgguuauagugguucagauacaguaggagcuggcuuuacucaagcaaaagaacauauaagaagaaauagacaaucaaggacauuuuuaguagaaaauguaauuggugaaauaugguccgaauuagaagaaggagacaaauauguagucguagacucugguggcggaacuguagaccuaacaguacaucaaauaagacuuccagaaggacaucuaaaagaauuauauaaagcaacgggaggccccuauggaucauuagguguagauuaugaauucgaaaaauuauuauauaaaauauuuggcgaagauuuuauagaacaauucaaaauaaaaagaccugcggcuuggguagacuuaaugauagcuuuugaaucaagaaaaagagcugccgccccagacagaacaaauccauuaaauauaacauuaccauuuucauuuauugauuauuauaaaaaauuuagaggacacucuguagaacaugcacuuagaaaaagcaacguagauuuuguaaaauggaguucucaaggaauguuaagaaugucaccagacgcaaugaacgccuuguucaaaccaacgauugauaguauaauagaacacuuacgcgacuuauuucaaaaaccagaaguaucaacagucaaauuucuauuuuuagucggaggauuugcagaagcaccacuucuacaacaagcaguacaagcagcauuuggagaucaaugcagaaucauaauaccucaagacguaggccucacgauucuaaaaggcgcagugcuauucggucuagauccagcaguuauaaaaguucggcgaucacccuuaacauauggaguuggaguauuaaaucgauacguagaaggaaaacauccaccagaaaaauuauuaguaaaagacgguacgagaugguguaccgauguauucgauaaauuuauaucagcagaccaaucaguagcucucggcgaacucguuaaaagauccuauacaccagcaaaaccaucucaauuaguuauaguaauuaauauauauucaagcgagcacgauaacguuucauuuauaacagauccagguguaaaaaagugcgguacauuaagacucgacuuaaccggaacaaguggaacagcaguuccagcacgcagagaaauacaaacauuaaugcaauuuggugauacugaaauaaaagcaacagccauagacauagccacaucaaaaucaguuaaaguuggaauagacuuucuaaauuacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4880 - RNA, 2408 nt, Artificial Sequence
  mRNA product Design3 comprising derived and/or modified sequence from Homo sapiens__NP_443202.3 __HsHSPA12B (opt12)
gggagagucccgcagucggcguccagcggcucugcuuguucgugugugugucguugcaggccuuauucaagcuuaccauguuagcaguaccagaaaugggauuacagggacuauauauuggaucuucuccagaaagaucaccaguaccaucaccacccgggucaccaagaacccaagaaagcuguggaauagcuccacuaacaccaucacaauccccuaaaccagaaguaagggcaccccaacaagccaguuucaguguuguaguagcaauagauuuuggaacuacaucaucagguuacgcauuuuccuuugcaucagauccugaagcaauucauaugaugagaaaaugggaaggaggagacccuggcguagcacaucagaaaacuccuacauguuuacuuuugacaccagaaggagcauuucauucauuuggauauacagcacgagauuauuaucacgacuuagauccagaagaagcuagagauuggcucuacuuugaaaaauuuaaaaugaaaauacauagugcaacagaucuaacauuaaaaacccaauuagaagcuguuaaugguaaaacuaugccagcgcuagaaguauuugcgcacgcauuaagauuuuuccgagaacaugcauuacaagaacuuagagaacaaucaccuucacuaccugaaaaagauacaguuagauggguauugacuguaccggcaauauggaaacaaccagcgaaacaauuuaugagagaagcugcauauuuagcuggguuaguaucacgagaaaaugcagagcaacucuuaauugcgcuugagccagaagcagcaucugucuacugcagaaaauuaagacuacaucaacuacuagauuuaaguggcagagcacccggagguggaagacuaggugagcgaagaagcauagauucaaguuuccgacaagcaagagagcaacuaagacgaucaagacacucaagaacauuucuaguagaaagcgguguaggagaauuaugggcagaaaugcaagcaggagaucgauauguaguugccgauugcggggguggcacaguagauuuaacaguccaucaacuagaacaaccacacggaacucuaaaagaacuauauaaagcaucaggagguccauacggcgcaguaggaguggacuuagcguucgaacaacuacuaugcagaauauuuggagaagauuuuauagcgacauuuaaaagacaaagaccugcggccuggguagaucuaacaauagcauucgaagcaagaaaacggacggccgggccgcauagagcaggagcucuaaauauaagccuaccauuuucauuuauagacuuuuauagaaaacagagaggacauaacguugaaacugcacugagacgauccucaguaaauuucguaaaauggucuucacaaggaauguugcgaaugagcugcgaagcaaugaaugaacuauuucaaccaacuguaaguggcauuauucaacauauagaagcacuauuagcaagaccugaaguccaaggaguuaaacugcuauuccugguagguggauuugcagaaucggcaguauuacagcaugcaguacaagcagcuuuaggugcaagaggauuacgaguaguaguaccacaugauguaggacuaacaauuuuaaaaggagcuguacuauucggccaagcuccaggaguuguaagaguuagaagaaguccauuaaccuacgggguagggguacuuaauagauucguaccuggacgacauccaccagaaaaauuauuaguaagggauggaagacgcugguguacagauguguucgaaagauucguagcugcugaacagagcguugcucuaggggaagaaguacgaagaucauacuguccagcuagaccaggccaaaggcgaguauuaauaaauuuauauuguugugcagcagaagaugcaagauucaucacugauccaggaguuagaaaaugcggagcacucucucuagaguuagaaccugcggacuguggacaagacaccgcaggagccccaccaggaaggagagaaauacgagcagcaaugcaauuuggugauacagaaauuaaagucacugcaguagauguaucgacaaauagaucaguaagagcuucgauugauuuccuuucgaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4881 - RNA, 1763 nt, Artificial Sequence
  mRNA product Design3 comprising derived and/or modified sequence from Homo sapiens__NP_008879.3__HsHSPA13 (opt12)
gggagagucccgcagucggcguccagcggcucugcuuguucgugugugugucguugcaggccuuauucaagcuuaccauggcucgagaaaugacaauuuuaggaucagcgguauugacacuuuuauuagcaggauaccuagcccaacaauaccuaccacuaccuacaccaaaagugauaggaauagaccuuggaacaacauacuguucaguaggaguauucuuuccaggaacagguaaaguaaaaguaauaccagaugaaaacggacacauaaguauacccucaaugguaaguuuuaccgauaacgauguauacguaggauacgaaucaguugaauuagcagacucaaauccacaaaacacaauauaugacgcaaaaagauuuaucggaaaaaucuucacagcagaggaauuagaagcagaaauaggaagauaucccuucaaaguauuaaauaaaaacggaaugguagaauucucugucacaucaaacgaaacaauaacaguaagcccagaauacguaggcagucgauuacuacuaaaacucaaagaaauggcagaagcguacuuaggaaugccaguagcaaaugccguaauaucagucccagcagaauucgaucuaaaacaacgaaacagcaccauagaagcagccaaucuagcaggauuaaaaauacuaagaguaauaaacgaaccaaccgcagcagccauggcauauggacuacacaaagcagauguauuucacguauuaguaauugaucuaggaggcggaaccuuagacguaucauuauuaaauaaacaaggaggaauguucuuaacuagagccaugucaggaaauaacaaacuaggaggacaagauuuuaaccaacgacucuuacaauacuuauacaaacaaauauaucaaacauauggauuuguuccuagcagaaaagaagaaauacauagacuaagacaagccguagaaaugguuaaauuaaaucuuacacuccaccaaagugcacaacuaagcguguuacuaacaguagaagaacaagacagaaaagaaccacacucuucagacacagaauuaccaaaggauaaauuaucaucagcagaugaccaccgaguaaauucaggauucggaagaggacuaucagauaaaaaaucaggagaaucacaaguucuauucgaaacagaaauaucaagaaaacuauuugacacauuaaacgaagauuuauuccaaaaaauacuaguaccaauacaacaaguacuuaaagaaggacaucuugaaaaaacggaaauagacgaaguaguacucguaggagguucaacaagaauaccaagaauaagacaaguaauucaagaauuuuuuggaaaagacccaaauacauccguagauccagaucuagccguaguaaccggcguagcuauacaagcaggaauagaugguggaucauggccauuacaaguaucagcacucgaaaucccaaacaagcacuuacaaaaaacaaauuucaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4882 - RNA, 1877 nt, Artificial Sequence
  mRNA product Design3 comprising derived and/or modified sequence from Homo sapiens__NP_057383.2__HsHSPA14 (opt12)
gggagagucccgcagucggcguccagcggcucugcuuguucgugugugugucguugcaggccuuauucaagcuuaccauggcagcaaucggaguucaucuaggauguacaagcgcaugcguagcaguauacaaagacggucgagcagguguugucgcaaacgaugcaggagauagaguaacaccagcuguaguagcauauagugaaaacgaagaaauaguaggauuagcagcaaaacaaagcaggauucgaaauauaucaaauacaguaaugaaaguaaaacaaauauuaggccgaagcagcuccgacccucaagcacaaaaauauauagcagaaaguaaauguuuaguaauagaaaaaaauggaaaacuaagauacgaaauugauacgggagaagaaacaaaauucguaaauccggaagauguagcaaggcuaauauuuagcaaaaugaaagaaacagcucauaguguauuaggaagcgacgcaaacgacguaguuauaacagucccuuucgauuuuggagaaaaacaaaaaaaugcucuuggagaagccgcaagagcagccggcuuuaauguacuaagacuaauacaugaaccaucagcagcucuauuagcauauggaaucggacaagauucaccaacagguaaaaguaacauacuaguauuuaaauuaggaggaacaucauuaucacuauccguaauggaaguaaauucaggaaucuauagaguauuaaguacaaacacagacgacaacauuggaggagcacacuuuacagaaacuuuagcacaauaucuugcauccgaauuucaaagaaguuuuaaacaugacguaagagguaacgcaagagcgaugaugaaacugacaaauucagcagaaguagcaaaacauagucuaucaacauuaggauccgcaaacugcuuucuagauaguuuauaugaaggacaagacuuugacugcaauguaucaagagcacguuucgaacucuuauguucaccguuauuuaauaaaugcauagaagcaauaagaggacuauuagaucaaaauggauuuacagcugaugauauaaauaaaguuguguuauguggaggaucaucaagaauaccaaaauuacaacaauuaauaaaagauuuauuucccgcaguagaauuauuaaauucaauaccaccagacgaaguaauuccaauaggcgcagccaucgaagcaggcauacuaauaggaaaagaaaaccuauuaguagaagacucauuaaugauagaauguucagcaagagauauauuaguaaaaggaguagaugaaaguggugcgucaagguuuacaguauuauuuccaagcggaacaccacuaccugcaagaagacaacauacgcuacaagcaccagguaguauaaguucaguaugucuagaacuauaugaauccgacggaaaaaacagcgcaaaagaagaaacaaaauuugcacaaguuguuuuacaagauuuagauaaaaaagaaaacggcuuaagagacauuuuagcaguauuaacaaugaaacgcgauggaucacuacauguaacauguacagaccaagaaacaggaaaaugcgaagcaauaaguauagaaauagcuucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4883 - RNA, 2924 nt, Artificial Sequence
  mRNA product Design3 comprising derived and/or modified sequence from Homo sapiens__NP_006635.2 __HsHSPH1 (opt12)
gggagagucccgcagucggcguccagcggcucugcuuguucgugugugugucguugcaggccuuauucaagcuuaccaugucaguaguaggacuugauguaggaucacaaucauguuacauagcaguagcuagagccggugggauagaaacaauagcaaacgaauuuagugauagaugcacaccaagugucauaucauuugguagcaaaaacagaacaauaggaguagcagcgaaaaaccaacaaauaacccacgcaaacaacacaguaucaaacuucaaaagauuccacggcagagcauuuaacgaccccuucauacaaaaagaaaaggaaaacuugaguuaugacuuaguaccacucaaaaauggaggaguuggaauaaaaguaauguacaugggggaagaacacuuauuuagcguagaacaaauuacugcaaugcuauuaacaaaacuuaaagaaacagcagaaaacucauuaaagaaaccaguaacagauuguguaaucuccguaccaucuuucuuuacagaugcagaaagacgauccgucuuagacgcagcacaaauaguuggccuaaauuguuuaagguugaugaacgacaugacugccguagcccuaaauuaugguauuuacaaacaagacuuaccaagccucgaugagaaaccccggauaguaguauuuguagacaugggacacagcgcauuucaagugagugccugugccuuuaacaaaggaaaacucaaaguucucgguaccgccuuugauccguuuuuaggaggcaaaaauuucgacgaaaaauuagucgaacauuuuugcgcagaauuuaaaacaaaauauaaauuagacgcgaaaagcaaaauaagagcgcuacugagauuauaccaagaaugugaaaaacuaaagaaacuaaugaguucaaauaguacagaccuaccacuaaauauagaguguuucaugaacgacaaagacguaagcggaaaaaugaauagaucacaguucgaagaacuuugugcagaacuauuacagaaaauagaaguucccuuauauucauuauuagaacaaacacacuuaaaaguagaggaugucucagcuguagaaaucgucggaggagccacccguauuccagcggucaaagaaagaauagcaaaauucuuuggcaaagacauaaguacaacccuaaacgccgaugaagcagucgcaagaggaugugcacuccaaugugcaauccuuaguccagccuuuaaaguaagagaguuuuccguaacugacgcaguaccauuuccuauuucucuaauuuggaaucaugauucagaagauacagaaggaguacaugaaguauuuucaagaaaccaugcagcaccguucaguaaaguauugacauuuuugcgaagaggcccauucgaacuagaagcauuuuacucagauccacaagggguaccauaccccgaagcaaaaaucggaagauuuguuguacaaaacgucucagcacaaaaagauggagagaaaagcagaguaaaaguaaaaguacgaguaaacacucauggaauauucacaauaucuaccgcaagcaugguagaaaaagucccaacagaagaaaacgaaaugucaagcgaagccgauauggaaugcuugaaucaacgaccgcccgaaaacccagauacugacaaaaacguacaacaagauaauucagaagcuggaacucaaccacagguacaaaccgaugcacaacaaaccucacaaagcccaccaagucccgaacuuacguccgaagaaaacaaaauaccagacgcagauaaagcaaacgagaagaaagucgaccaaccaccagaagcaaagaaaccgaaaauaaaaguagugaauguagaauuaccaauagaagccaaccuaguguggcaacuaggaaaagaccuccuaaacauguacauugaaacagaaggaaaaaugauaaugcaagauaaauuggagaaagaaagaaacgacgccaaaaaugcaguagaagaauacgucuacgaguucagagauaaacuaugugguccauaugaaaaauucauaugugaacaagaucaccaaaauuuccuuagauuacuuacagaaacugaagauugguuauaugaagaaggcgaagaucaagcaaaacaagccuacgucgacaaauuagaagaauuaaugaaaauaggaacaccagugaaaguaagauuccaagaagcagaagaaagaccaaaaauguuugaagaauuaggucagcgcuuacaacauuacgccaaaauugcagcagauuuuagaaauaaagaugaaaaauauaaccauauugacgaaucagagaugaagaaaguagaaaaaucagucaaugaaguaauggaauggaugaauaauguaaugaacgcucaagcaaagaaaucauuagaccaagacccaguagugagagcccaagaaauaaaaacaaaaauaaaagaauuaaauaauacaugugaaccuguuguuacacaaccaaaaccaaaaauagaaaguccaaaacuagaacgaacgccaaacggaccaaauauagacaagaaagaagaagaucuagaagacaaaaauaacuucggugcagaaccuccacaucaaaacggagaauguuacccaaacgagaaaaacaguguaaacauggacuuagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4884 - RNA, 3347 nt, Artificial Sequence
  mRNA product Design3 comprising derived and/or modified sequence from Homo sapiens__NP_006380.1 __HsHYOU1 (opt12)
gggagagucccgcagucggcguccagcggcucugcuuguucgugugugugucguugcaggccuuauucaagcuuaccauggccgauaaaguaaggcgccaacguccaagaagaagaguauguugggcacuuguugcaguucuacuugcagacuuauuagcacuaagugauacacuugcagugaugaguguagaucuuggauccgaaagcaugaaaguagcaaucguaaaacccggaguaccaauggaaauuguacucaacaaagaaagucgaagaaaaacaccaguaaucguaacucuaaaagaaaaugaaagauuuuucggggauucugcagcaucuauggcaauuaaaaacccaaaagcuacauuacguuacuuccaacauuuacuugguaagcaagcagauaacccucacguugcucuauaucaggcucguuucccagaacaugaacucacauucgacccacaacgacagacaguacacuuucaaauaucaagccaauuacaauucucaccagaagaaguacuagguaugguacuaaacuauucgcgaaguuuagcagaagacuucgcugaacaaccaauaaaagaugccguaauaacagucccagucuucuuuaaccaagcagaaaggagagccguucuacaagcggcuagaauggcaggauuaaaaguauugcaacuaauaaaugacaauacugcgaccgcccuaaguuacggcguuuuucgaagaaaagauauaaauacaacagcccaaaacauaauguucuacgacaugggaaguggaucaacaguaugcacuauaguuacauaccaaaugguaaaaacgaaggaagcaggaaugcaaccacagcuacaaauaagaggaguaggauuugaucguacacuaggaggauuagaaauggaacuaagacuuagagaacgcuuagcaggauuguucaaugaacaaagaaagggccaacgcgccaaggaugugagagagaauccaagagcaauggcaaaauuacucagagaggccaaccgguuaaaaacaguguuaucagcaaacgcagaucauauggcucagauagaaggacugauggaugacguugauuucaaagcaaaagucacacgaguugaauuugaagaguuaugugcagauuuauucgaaagaguuccuggaccuguucaacaagcgcuacaaagugcagaaaugaguuuagaugagauugaacaagugauucuaguuggcggagcaacucgaguuccaagaguccaagaaguacuguuaaaagccguaggcaaagaagaauuagguaaaaauauaaaugccgaugaagcagccgcaaugggagccguuuaucaagcugcugccuuaucgaaagcauuuaaaguaaaaccauuuguuguaagggacgccgugguauacccaauauuagucgaguuuacacgagaagucgaagaagaacccggaauacauucauuaaaacauaacaaacgaguucuauuuucaagaauggggccguauccacaaagaaaaguaauaaccuuuaauagauacucccacgauuuuaauuuccacauuaauuauggagaucuaggauuuuuagguccggaagaucuucguguauuugggucacaaaauuugacaacagucaaacuaaaaggagucggagacucauuuaagaaauauccagauuaugaaucaaaaggaauuaaagcucauuucaauuuggaugaaaguggaguacucagucuagauaggguagaaagcguauuugaaacauuagucgaagacucagcagaagaagaaagcacucugacuaaacuaggaaauacaauaucaucacuauucggaggugggacgaccccagaugcaaaagaaaauggaacagauacuguacaggaagaagaagaaucaccagcagaaggaagcaaggaugaaccaggugagcaaguagaacuaaaagaagaagcagaagcaccaguagaagacggaagucaaccaccuccaccagaaccuaaaggagacgcgaccccagaaggagaaaaagcuacagaaaaggaaaauggagauaaaucagaagcucaaaaaccgucagaaaaagcugaagcaggaccagaaggcguugccccagcaccggagggagaaaagaaacaaaaaccagcaagaaaaagaagaaugguggaagaaaucgguguagagcuaguaguauuagacuuaccugacuuaccagaagauaaauuggcucaauccguucaaaaacuucaagaucuaacacuuagagacuuagaaaaacaagaacgagaaaaagcagcaaacucacuagaagcauuuauauucgaaacacaggauaaacuauaccaaccagaauaccaagagguuucaacugaggaacaaagggaagagaucucaggaaaacucagugcagccaguacaugguuggaagacgaaggaguaggcgcaacaacggucauguuaaaagaaaaacuagcggaacuuagaaaauuaugccaaggauuauuuuucagaguugaagaaagaaagaaauggccagaaagauuauccgcuuuggauaauuuauuaaaucauucaucaauguuucuaaaaggcgcaagauuaauaccugaaauggaucaaauauucacagaaguagaaaugacuacauuagaaaaaguaauaaaugaaacuugggcuuggaaaaaugcuacacuagcagaacaagcaaaauuaccagcuaccgaaaaaccaguacuacuaucaaaagacauagaggcaaaaaugauggcccuagacagagaaguucaauaucuacuaaauaaagcaaaauuuacuaaaccuagaccaagaccuaaagauaaaaaugguacacgagcugagccuccacucaaugcguccgcauccgaucaaggagaaaaaguuauacccccugccggacaaacagaagacgcagagccaaucucagaaccagaaaaaguggaaacaggaagugaaccuggagacacagaaccacuagaacucggagguccgggggcagaaccagaacaaaaagaacagaguacaggacaaaaacgaccgcuaaagaaugaugaguuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4885 - RNA, 2546 nt, Artificial Sequence
  mRNA product Design3 comprising derived and/or modified sequence from Homo sapiens__NP_005339.3 __HsHSP90AA1 (opt12)
gggagagucccgcagucggcguccagcggcucugcuuguucgugugugugucguugcaggccuuauucaagcuuaccaugccagaggaaacccaaacucaagaucaaccaauggaagaagaagaaguagaaacauuugcuuuccaagccgaaauagcacaacugaugucacuaauaauaaauacauuuuauucaaacaaggaaauuuucuugagagaacucauaaguaacucaagcgacgcacucgacaaaauaagauacgaaagccuaacagacccgucuaaacuggacucaggaaaagagcuacauauaaaccuaauaccuaacaaacaagauagaacacuaaccauaguagauacaggaauagguaugacaaaagcagauuuaauaaacaaccuaggcacaauagccaaguccggaaccaaagcguucauggaagcgcuccaagccggcgcagauaucagcaugauaggacaauucgggguaggauucuacucagcauaucuaguagcagaaaaaguaacgguuaucaccaaacauaaugacgacgaacaguacgcaugggaaaguucggcaggcggcucauucacagucagaaccgacaccggggaaccaaugggaagagguacaaagguaauacuacaccuuaaagaagaccaaacagaauaccuagaagaaaggagaauaaaagaaauaguaaaaaaacacucacaauucauuggauacccaauaacauuauuuguagaaaaagaaagagacaaagaaguaagcgacgaugaagcagaagaaaaagaagauaaagaagaagagaaagaaaaagaagagaaagaaagugaagacaaaccagaaauagaagacguuggcucggaugaagaagaagaaaaaaaagacggagauaaaaaaaaaaaaaaaaaaauaaaagaaaaguacauagaucaagaagaacucaauaaaacaaagccaauauggacacgaaauccagaugacauaacuaacgaagaauacggcgaauuuuauaaaaguuuaacaaacgacugggaagaccaucucgcaguaaaacauuuuucaguagaaggacaacuagaauucagagcacuauuauucguccccagaagagcaccauuugauuuauuugaaaauagaaaaaaaaaaaacaacauuaaacuauauguaagaagaguuuucauaauggacaauugugaagaauuaauaccagaauaucuaaacuuuauaagaggggugguugacagcgaagauuuaccgcuuaacauaagccgagaaauguugcaacagaguaaaauacuaaaaguaauaagaaaaaaucuaguaaaaaaauguuuagaauuauuuacggaauuagcagaggacaaagaaaacuacaagaaauuuuacgaacaauucaguaaaaacauaaaauuaggcauacacgaagacagucaaaauagaaagaaacuaucagaacuacuaagauauuacacaagugcaaguggagaugaaaugguaagcuuaaaagacuacuguacaagaaugaaggaaaaccaaaaacauauauauuauauaacaggagaaacaaaagaucaaguagcaaacagugccuucguagaaagacuaagaaaacaugggcuagaaguaauauacaugauagaaccuauagaugaauauugcguacaacaacuaaaagaauuugaaggaaaaacccuaguaucgguaacaaaggaaggauuagaauuacccgaagaugaagaagaaaaaaagaaacaagaagaaaaaaaaacaaaauucgaaaaccuaugcaaaauaaugaaagauauacuagaaaaaaaaguugaaaaaguugugguaucuaacagauuaguaacuucaccaugcugcaucguaacuaguacguauggcuggacagcaaacauggaaagaauaaugaaagcacaggcuuugagagauaacaguaccaugggauauauggcagcaaaaaaacaucuagaaauuaauccagaccacaguauaauagaaacguuaagacagaaagcagaagcggacaagaacgacaaaucaguaaaagaccucguuauacuacucuaugaaacagcacuacuaagcaguggauuuucauuagaagauccacagacacacgcaaacaggauuuauagaaugauuaaacuuggacucggaauagacgaagaugacccaacagcagaugacacaagugcagcagugaccgaagaaaugccaccguuagaaggggaugacgacacuaguagaauggaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4886 - RNA, 686 nt, Artificial Sequence
  mRNA product Design3 comprising derived and/or modified sequence from Homo sapiens__NG_005218__HsHSP90AA3P (opt12)
gggagagucccgcagucggcguccagcggcucugcuuguucgugugugugucguugcaggccuuauucaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauuuauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4887 - RNA, 2522 nt, Artificial Sequence
  mRNA product Design3 comprising derived and/or modified sequence from Homo sapiens__NP_031381.2__HsHSP90AB1 (opt12)
gggagagucccgcagucggcguccagcggcucugcuuguucgugugugugucguugcaggccuuauucaagcuuaccaugccagaagaaguacaccauggagaagaagagguagaaacauucgcauuucaagcagagauugcacaacuaaugaguuugauaauaaauacauuuuauagcaacaaagaaauauuuuuaagagaacuaauuucuaacgcaagcgacgcauuagacaaaauacgauaugagagucuaacugauccaaguaaacuagauaguggaaaggaacuuaaaauagacauaauaccgaauccacaagaacgaacauugacacuaguggacacaggcauaggaaugacaaaggccgaucuaauaaauaaucuuggcacaauagcaaaaagugggacuaaagcguuuauggaggcacuacaagcgggagcagauauaaguaugauaggacaauuuggaguuggauuuuauucagcauacuuaguggcagaaaaaguugucguaauaacaaaacauaacgaugacgaacaauacgccugggaaucaagcgcaggaggaaguuuuacaguaagagcagaccacggugaaccaaucggaaggggaacaaaaguaauacuacacuuaaaagaagaucaaacagaguauuuggaagaacgaaggguaaaagaaguaguaaaaaaacacucacaauuuauaggauauccgauaacauuguaccuagaaaaggaaagggaaaaagaaauaagcgaugacgaagcagaagaagaaaaaggggaaaaggaagaagaagauaaagacgaugaagaaaaaccaaaaauagaggacguaggaagugaugaagaagaugacucaggaaaagauaaaaaaaaaaaaacuaaaaaaaucaaagaaaaauacauagaucaagaagaauuaaauaaaacaaagccaauauggaccagaaacccagacgacauaacacaagaagaauauggcgaauucuauaaaagucuaacaaaugacugggaagaccaccuagcaguaaaacacuucagcgucgaaggucaauuagaauucagagcucuacuauuuauaccaagaagagcaccauucgaucuauucgaaaacaaaaaaaaaaaaaauaauauaaaacucuacguccgcagagucuuuauaauggacucgugcgacgaacuaaucccagaauauuuaaacuuuaucagagggguaguagacucagaggaccucccacuaaacauaagcagggaaaugcuucaacaaagcaaaauccuaaagguaaucagaaaaaauaucgucaaaaaaugccucgaacuauuuucagaauuagccgaagauaaagaaaacuacaaaaaauuuuacgaagcauucagcaaaaauuuaaaacuaggcauacacgaagacuccacaaacagaagaagauuaagcgaauuacuaagauaucacacaucacagucgggagaugaaaugacaucuuuaucagaguacguaagccgaaugaaagaaacacaaaaaaguauauacuauaucacuggagaaaguaaagaacaaguagcgaacucagcauuuguagaacguguaagaaaacgaggauuugaaguaguauacaugacagaaccaauugacgaauacuguguccaacaauuaaaagaauucgaugguaaaaguuuaguuucaguaacaaaagaaggauuagaauuaccugaagacgaagaagaaaagaaaaaaauggaagaaagcaaagcaaaauuugaaaaucuaugcaaacucaugaaagaaauauuagacaaaaaaguggaaaaagucacgauuuccaacagacucguaagcucacccuguugcauaguaacaucuacauaugguuggacugcaaacauggaaagaauaaugaaagcacaagcuuugagagacaauucaacaaugggauauaugauggcaaagaaacauuuagaaauaaacccagaccauccaaucguagaaacacugagacaaaaggcagaagcagacaaaaaugauaaggccgugaaagaucuugugguacuucuauucgaaacagcccuacugaguaguggauucaguuuagaagacccacaaacacacuccaauagaaucuaucgaaugaucaaacuaggauuaggaauagacgaggaugaaguagcugcagaagaaccaaaugcagcaguaccagaugaaauaccaccgcuagaaggagaugaagaugcgagccgcauggaagaaguagacuagggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4888 - RNA, 2759 nt, Artificial Sequence
  mRNA product Design3 comprising derived and/or modified sequence from Homo sapiens__NP_003290.1__HsHSP90B1 (opt12)
gggagagucccgcagucggcguccagcggcucugcuuguucgugugugugucguugcaggccuuauucaagcuuaccaugagagcacuguggguauuaggauuaugcugcguauuacuaacguuuggaucagugagagcagaugaugaagucgauguugauggaacaguagaggaagaccucgguaaaaguagagaaggcucaagaacugacgacgaaguuguucaaagagaagaagaagcgauacaauuagauggauuaaaugcaucacaaauaagagaacuucgugaaaaaucagaaaaauuugcguuucaagcagaaguaaacagaaugaugaaacuaauaauaaauucauuauacaaaaauaaagaaauauuuuuaagagaacuuauuucaaacgcaagcgaugcauuggauaaaauaagauugauaagucuaacagaugaaaacgccuuaucaggaaaugaagaauuaacaguaaaaauaaaaugcgauaaagagaaaaauuuacuacauguaacugacacgggaguaggaaugacaagagaagaauuagucaaaaauuugggaacaauagccaaaucaggaaccucagaauuucuaaacaaaaugacugaagcacaagaagacgggcaaucaacaagugaauuaauaggacaauuugggguaggauucuacagugcguuuuuaguagcggacaagguaauaguaaccaguaaacauaauaacgacacacaacauauaugggagucagacaguaacgaguucaguguaaucgcagacccgagagguaacacauugggacgaggaacaacuauaacguuaguacucaaagaagaggcuucagauuaccuagaacuggauacaauaaagaaucucgugaagaaauauucccaauucaucaacuucccaauauacguauggaguucaaaaacagaaacaguggaggaaccaauggaagaagaagaagcagcuaaagaagagaaagaagaaucagaugaugaagcugcagucgaagaagaagaagaagaaaagaaaccgaaaacuaagaaaguagagaaaacaguuugggauugggaacuaaugaacgacauaaaaccaauuuggcaacgaccgucaaaagaaguggaagaggaugaauauaaagcauuuuacaaaucauucucuaaagaaucagaugauccaauggcauauauacauuuuacagcagaaggggaaguaacauuuaagucaauccuauuuguaccaaccucagcaccgaggggauuauucgacgaauauggaagcaagaaaucggauuauauaaaacuauauguaagaaggguauuuauaaccgaugauuuccacgauaugaugcccaaauaucuaaauuuuguaaaaggaguaguagacagcgacgaucuaccauuaaauguaucucgagaaacacuccaacagcauaaacuccuaaaaguuauaaggaagaaauuagucaggaaaacacucgauaugauaaagaaaauagcagaugauaaauauaacgacacauuuuggaaagaauuugguacaaauauuaaauuaggaguaaucgaagaucacaguaacagaacgagauuagcaaaacuauugagauuucaaaguucacaccacccaacagauauaacuagcuuagaccaauauguggaaaggaugaaagaaaaacaagauaaaauuuauuuuauggcagggaguaguaggaaagaagcugaaaguagccccuucguggaaagauuauuaaagaaaggauaugaaguaauauaucuaacagaaccaguagacgaauauuguauacaagcacuaccagaguucgacggaaaaagauuucaaaauguagccaaagaaggaguaaaauuugacgagucagagaaaacaaaagaaagcagagaagcaguagaaaaagaauuugaaccucuacuuaacuggaugaaagauaaggcuuuaaaagauaaaauagaaaaagcaguaguaagccaaagacuuacagaaucaccaugugcauugguagcaagucaauauggauggaguggaaacauggaaaggauaaugaaagcacaagcguaccaaacaggaaaagauauaucaacgaauuacuaugccagccagaaaaagacauucgaaauaaauccaagacacccauuaauaagagacauguuaagaagaauuaaagaagaugaagaugauaaaacuguauuagaccuugcaguaguuuuguucgaaacggcaacauuacgaaguggcuaucugcuaccggauacaaaagcauauggagacagaauagaacgaauguuaagacuaucauuaaauauagauccugaugccaaaguagaagaagaaccagaagaagaaccagaagaaacggcagaagauacaacagaagacaccgaacaagacgaggaugaggaaauggacguaggaacugaugaagaagaagaaacagcaaaagaaagcacugcagaaaaagaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4889 - RNA, 2462 nt, Artificial Sequence
  mRNA product Design3 comprising derived and/or modified sequence from Homo sapiens__NP_057376.2__HsTRAP1 (opt12)
gggagagucccgcagucggcguccagcggcucugcuuguucgugugugugucguugcaggccuuauucaagcuuaccauggcaagagaacuaagagcauuacuauuauggggccgccgacuaagaccucucuuaagagcuccagcacuagcagccguaccaggcggaaagcccauacuauguccaaggagaacaacugcacaacuaggaccaagaagaaauccugcuuggagucugcaagcagguaggcuuuucuccacacaaacagcugaagacaaagaagaacccuuacauucaauaauaucuaguacagaaucuguucaaggaaguaccucaaaacaugaauuucaagcagaaacaaaaaaacuacuagacauaguagcacgaucacuauauagugaaaaagaaguuuuuauaagagaauuaauaaguaacgccucagaugcacuagaaaaauuacgacacaaauuaguaagcgauggucaagcuuuaccagaaauggaaauacauuuacaaacuaacgcugaaaaaggaaccauuacaauacaagauacagguauaggaaugacacaagaagaacuuguuaguaaucuaggaacaauagcucgaucaggaucaaaagcauucuuagacgcauuacaaaaccaagcagaagcuagcucgaaaauaauuggucaauuuggaguaggauuuuauucagcauucaugguugcagacaggguagaaguauauucacguagcgcugcaccaggaucauuagguuaccaauggcuaucagacgguucaggcguuuucgaaaucgcagaagcaucaggaguaagaacaggaacaaaaauaauaauacaccuaaaaagugauuguaaagaguucucuagugaagcaagaguuagagauguaguaacaaaauauucuaauuuuguaucguuuccacuauacuuaaauggacgaagaaugaauacacuacaagcaauauggaugauggauccaaaagauguacgagaauggcaacaugaagaauucuacagauacguugcacaagcacaugacaaaccaagauauaccuuacauuauaaaaccgacgcaccuuuaaauauaagaucaaucuuuuauguuccagacaugaaacccucuauguucgacguaucaagagaacuaggaaguaguguggcccuuuauucaagaaaaguccuaauucaaacaaaagcaacagauauauuaccuaaaugguugagauuuaucagaggaguaguagauucagaagacaucccauuaaaucuaaguagggagcuauuacaagaaucagcauuaauaaggaaacuaagagacguuuuacaacaaagacuuauaaaauuuuuuauagaucaaagcaaaaaagaugcagaaaaauacgcuaaauuuuucgaagacuaugggcuauuuaugagagagggaauaguaacagcaacugaacaagaaguaaaagaagacauugcaaaacuacucagauaugaaaguagugcucugccuagcggucaauuaacaagucugucugaauaugcuucacgaaugagggccggaacaagaaauauauacuacuuaugcgcaccaaaccgacacuuagcagaacauucacccuauuaugaggcaaugaaaaagaaagacacagaaguucuauuuugcuuugaacaauucgacgaacucacuuuacuacaccuaagagaauuugacaaaaaaaaauuaauuagcgucgaaacagauauagugguugaccauuauaaagaagaaaaauuugaggauagaucuccagcggccgaaugccuuucagaaaaagaaacagaagaacuuauggccuggaugagaaacguucuagggucuagaguaacaaaugugaaaguaacauuaagauuagacacacauccggcaaugguaacaguucuagaaaugggagcggcaagacacuuuuuaagaaugcaacaauuggcaaaaacacaggaagaaagagcacaauuauuacagccaacacucgaaaucaacccuagacacgcauuaauaaaaaaacuaaaucaacuaagagcaucagaaccaggacuugcacaauugcuagucgaucaaauauacgaaaaugcaaugauagcagcaggauuaguagaugauccacgagcgaugguaggacgacuaaaugaguuauuaguaaaagcauuagaaagacacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4890 - RNA, 809 nt, Artificial Sequence
  mRNA product Design3 comprising derived and/or modified sequence from Homo sapiens__NP_000609.1__HsIGF1 (opt12)
gggagagucccgcagucggcguccagcggcucugcuuguucgugugugugucguugcaggccuuauucaagcuuaccaugggaaaaauaucaucacuaccaacacaacuauucaaaugcugcuucugcgacuuccuaaaaguaaaaaugcacacaaugucaucaucacaccuauucuaccuagcacuaugcuuauuaacauucacaucaucagcaacagcaggaccagaaacacuaugcggagcagaacuaguagacgcacuacaauucguaugcggagacagaggauucuacuucaacaaaccaacaggauacggaucaucaucaagaagagcaccacaaacaggaauaguagacgaaugcugcuucagaucaugcgaccuaagaagauuagaaauguacugcgcaccacuaaaaccagcaaaaucagcaagaucaguaagagcacaaagacacacagacaugccaaaaacacaaaaagaaguacaccuaaaaaacgcaucacgaggaucagcaggaaacaaaaacuacagaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4891 - RNA, 890 nt, Artificial Sequence
  mRNA product Design3 comprising derived and/or modified sequence from Homo sapiens__NP_000603.1__HsIGF2 (opt12)
gggagagucccgcagucggcguccagcggcucugcuuguucgugugugugucguugcaggccuuauucaagcuuaccaugggaauaccaaugggaaaaucaaugcuaguacuacuaacauuucuagcauucgcaucaugcuguauagcagcauacagaccaucagaaacacuaugcggaggagaauuaguagauaccuuacaauuuguauguggagacagaggauucuauuucucaagaccagcaucaagaguaucaagaagaucaagaggaauaguagaagaaugcuguuucagaucaugugacuuagcauuacuagaaacauauugcgcaacaccagcaaaaucagaacgagauguaucaacaccaccaacaguacuaccagauaacuuuccaagauacccaguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccacuaauugcauuaccaacacaagauccagcacacggaggagcaccaccagaaauggcaucaaacagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4892 - RNA, 986 nt, Artificial Sequence
  mRNA product Design3 comprising derived and/or modified sequence from Homo sapiens__NP_000591.1__HsIL6 (opt12)
gggagagucccgcagucggcguccagcggcucugcuuguucgugugugugucguugcaggccuuauucaagcuuaccaugaacucauucucaacaucagcauucggaccaguagcauucucacuaggacuacuacuaguacuaccagccgcauucccagcaccaguaccaccaggagaagacucaaaagacguugcagcaccacacagacaaccccuaacauccucagaaagaauagacaaacaaauaagauacauacuagacggaauaucagcacuaagaaaagaaacaugcaacaaaucaaacaugugcgaaucaucaaaagaagcacuagccgaaaacaaccuaaaccuaccaaaaauggcagaaaaagacggaugcuuccaaucagguuucaacgaagaaacaugccuaguaaaaauaauaacaggacuccuagaauucgaaguauaccuagaauaccuacaaaacagauucgaaucaucagaagaacaagcaagagcaguacaaaugucaacuaaaguacuaauacaauuccuacaaaaaaaagcaaaaaaccuagacgcaauaacaacaccagacccaacaaccaacgcaucacuacucacaaaacuacaagcacaaaaccaauggcuacaagacaugacaacacaccuuauacuacgaucauucaaagaauuccuccaaucaucccuccgagcccucagacaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4893 - RNA, 1628 nt, Artificial Sequence
  mRNA product Design3 comprising derived and/or modified sequence from Homo sapiens__NP_002183.1__HsINHBA (opt12)
gggagagucccgcagucggcguccagcggcucugcuuguucgugugugugucguugcaggccuuauucaagcuuaccaugccauuacuaugguuaagaggauuuuuauuagcuaguugcuggauaauagucagaucaagcccaacgccaggaagcgaaggacacucagcagcuccagacuguccaaguugugcauuagcagcauuaccuaaagauguuccuaauucacaaccagaaaugguagaagcaguaaaaaaacauauauuaaauauguuacacuuaaaaaaaaggccagacguaacacaaccaguuccaaaagcagcauuauugaacgcaauaagaaaauuacacguaggaaagguaggggaaaacggauauguagaaauagaagacgauauaggaagaagagcagaaaugaaugaacuaauggaacaaacaagugaaauaauaacuuucgcagaaagcggaacagcaagaaaaacacuacacuuugaaauaaguaaagaagggagcgauuuaucaguaguagaaagagcagaaguaugguuauuucuaaaaguaccaaaagcaaauagaacuagaacaaaaguaacaauaagacuauuccaacaacaaaaacauccacaaggaucuuuagauacuggagaagaagcggaagaaguaggacuuaaaggagaaagaucagaacuacuauuaagugaaaaaguaguagaugcacgaaaaaguacauggcauguauuuccaguauccaguucaauacaaagacuauuagaucaaggaaaaagcagcuuagacguuagaauagcuugugaacagugucaagaaucaggagcaaguuuaguuuuacuaggaaaaaaaaaaaaaaaagaagaagagggagaagguaaaaaaaaaggugggggagaaggaggagcaggagcugaugaagaaaaagaacaaucacauagacccuucuuaaugcuacaagcaagacaaucagaagaucauccacauagaagaagacgaagaggcuuagaaugugauggaaaaguaaauauauguugcaaaaaacaauucuuuguaucauuuaaagauauaggauggaaugauuggauaauugcacccagcgguuaucaugcaaacuauugugaaggagaaugcccaucacacauagcgggaacuaguggaaguucauuaagcuuucacucaacugugauaaaucauuaucguaugagaggccauucgccguuugcaaauuuaaaaucauguuguguaccaacaaaacuaagaccaaugaguauguuauauuaugacgauggacaaaauauaauaaagaaagacauacaaaauaugauaguagaagaauguggauguaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4894 - RNA, 1571 nt, Artificial Sequence
  mRNA product Design3 comprising derived and/or modified sequence from Homo sapiens__NP_002184.2__HsINHBB (opt12)
gggagagucccgcagucggcguccagcggcucugcuuguucgugugugugucguugcaggccuuauucaagcuuaccauggacggauuaccuggcagagcuuugggagcagcaugucuauuacuauuagcugcaggaugguuaggaccagaagcauggggaucgccaacaccaccaccaacaccagcugcaccaccaccaccaccaccuccugguucaccaggcgggucucaagacaccuguacaagcuguggaggcuuuaggaggccagaagaacuaggaagaguagauggagacuuuuuagaagcuguaaaaagacauauacuuaguagacuccaaaugagaggaagaccaaauauaacacaugccguaccaaaagcugcaaugguaacugcacuucgaaaacuacaugcaggaaaaguaagagaagauggaaggguagaaauaccucaucuagauggacaugcaucaccaggagcagauggacaagaaagaguaucagaaauaauaucuuuugcagaaacagauggauuagcgucaucaagaguaagauuauacuuuuucauaucaaacgaaggaaaucaaaauuuauuuguaguacaagcgagcuuaugguuauaucuaaaauuauuacccuauguuuuagaaaaaggaucaagacgaaaaguaagaguaaaaguuuauuuucaggaacaaggacacggagacagauggaauaugguagaaaagagaguagacuuaaaaagaaguggauggcauacauucccacuaacugaagcaauucaagcacuauuugaaagaggagaaagaagauuaaaccuagaugugcaaugugauucuugucaagaauuagcagucguaccaguauuuguugauccaggagaagaaagucauagaccauuugugguaguucaagcaagauuaggagauaguagacauaggauaagaaaaagaggauuagaaugugauggaaggacaaauuuauguuguagacaacaauucuuuauugacuuuagauuaauaggauggaaugauuggauaauagcacccacaggauauuaugggaauuauugugaaggaaguuguccagcauacuuagcaggaguacccggaucagcaaguuccuuucauacagcaguugucaaccaauaucgaaugagaggguuaaauccagguacaguaaacucauguuguauaccaaccaaacuaaguacuaugagcauguuauauuuugaugaugaauauaacauuguaaaacgagauguaccaaacaugauaguagaagaauguggaugugcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4895 - RNA, 3806 nt, Artificial Sequence
  mRNA product Design3 comprising derived and/or modified sequence from Homo sapiens__NP_000623.2__HsITGAM (opt12)
gggagagucccgcagucggcguccagcggcucugcuuguucgugugugugucguugcaggccuuauucaagcuuaccauggcauuaagaguauuacugcugacagcuuugacucuaugucacggcuucaaccuagacacagaaaaugcuaugaccuuucaagaaaaugcacgagguuucggacagucugucguccaacuacaaggaucaaggguuguagucggcgcaccccaagaaauuguagcagcaaaucaaagaggcuccuuauaucaaugcgacuacucaacagguagcugcgaaccaauacgucuucaaguucccguugaagcagugaacaugucacuugguuuaaguuuagcagcuacaacaagcccaccucaacuauuagcuugcggccccacaguacaccaaaccuguagcgaaaauacuuauguuaaaggauuguguuuccuauucgguuccaauuuacgacagcaaccucaaaaauucccugaagcacuucguggaugcccccaagaagauagcgauauagcauuuuuaaucgacgguuccggauccauaauaccccaugacuuccggagaaugaaagaauuuguaaguacagugauggaacaauugaagaaaucuaaaacucuauuuucucugaugcaauauagugaagaauuuaggauacacuuuacuuuuaaagaauuucaaaacaacccaaauccgagaucguuaguaaaaccgauuacucagcuuuuaggacgaacucauacagcuacuggaauacguaaaguaguaagagaacucuucaacauaacaaauggcgcacguaaaaaugcuuuuaagauauuaguaguaauuacagacggagaaaaauucggagauccucuaggauacgaagacguaauaccagaagcugauagagagggcguaauaagauauguaauaggcguuggagaugcauucagaagcgagaaaagcagacaagaauugaacacaaucgcaucuaaacccccacgagaucauguauuccaggucaauaauuucgaagcucuaaaaacaauacaaaaccaacugagagagaaaauauuugcaauagaagggacacaaacaggcucaucgagcucauuugaacaugaaaugagccaagaaggauuuucagcagcaauaaccucaaacggaccacuauuauccacuguuggaaguuaugauugggcagggggagucuucuuauacacguccaaagaaaaaucuacauuuauaaacaugaccagaguugacagugacaugaaugacgcuuaccucggcuaugcagcagcuauuauacuacgaaauagaguacaaucacuuguuuuaggggcaccacgguaccaacauauuggucuaguugccauguuccgacaaaauacaggaaugugggaaucaaaugccaauguaaaaggaacacaaauaggagcuuauuucggcgcaucauuauguuccguagauguagacucaaacggaucaacagauuuaguccugauuggugccccacauuauuaugaacaaacaagagguggucagguaaguguuuguccgcucccacgagguagagcccgauggcaaugcgaugcuguacuuuauggagaacaaggacagccauggggaagauucggggcagcacuaacaguacuaggugacgugaauggggauaaacuaaccgauguagcaauaggugcaccaggcgaagaagacaauagaggagcaguauacuuauuucacggaacaucaggcucaggaauaagcccuucgcacucacaaagaaucgcuggcaguaaauuaagcccucgccuucaauacuuuggacagucgcuuaguggaggccaagaucuaacaauggacggauuaguugaccuaacgguaggagcacagggucauguccuacuauuacgaucccaaccuguuuugcgugucaaagcaauuauggaguucaauccaagagaaguagcacgaaauguuuuugaaugcaaugaucaaguaguuaaaggcaaagaagcuggagaaguacggguuugucuacauguacaaaaauccacacgagaccgucuacgcgaaggucaaauacaaucaguaguuaccuaugaucuugcacuugacucuggaagaccucacucuagggcuguauuuaaugaaacuaaaaauuccacgagacgacaaacacaaguacuaggucuuacccaaacuugugaaaccuuaaagcuacaacucccaaauugcauagaagauccaguaaguccaauaguacugagacucaauuucucccuugucggaaccccucuaagcgcguucggaaacuuacgaccaguacuagcagaagacgcacagagacuuuuuacugcacuuuuuccauucgagaaaaauugcggaaacgacaauauaugucaagacgacuuaucuauaacauuuucauucaugucauuagauuguuugguaguuggagguccccgggaguucaaugucacaguaacagucagaaaugauggagaagauucuuaccgaacacaaguuaccuuuuucuuuccacuugauuuaagcuaccgaaaagucucuacacuacagaaccaacgaagucaacgcucguggagacuugcaugugaaagcgcuucuucaacugaaguuucaggugcuuugaaaucaacaucauguaguauaaaccaucccauuuuuccggaaaauucugaaguuacauuuaacauuacguucgaugucgauucaaaggcuucucuugguaauaaauuacuauugaaagcaaaugucacauccgaaaauaauaugccaaggaccaacaaaacagaguuccaacuugaauuaccuguaaaauaugcugucuacaugguuguaacaucacauggaguaucuaccaaauaucucaauuuuacagcaucugaaaauacuucacgaguaaugcaacaccaauaccaaguaucaaauuuaggacaacgaucacucccaauuagucuuguuuuucuagucccagucagauugaaucaaacaguaaucugggauagaccacaaguaacauuuucugaaaacuuaagcaguacaugucauacaaaagaacgcuuaccaucccauuccgacuuucuugcugaauuaagaaaagcaccugucgucaauugcucaaucgcagugugccaacgaauacaaugugacauucccuucuuuggcauacaagaagaguuuaacgcuacacuaaagggcaauuuauccuuugacugguacauaaaaacaucacauaaucaucuauuaauuguaucaacagcagaaauauuauuuaacgacagcguauucacacuucuccccgggcaaggagcuuuugucagaagucaaacagaaacaaaaguagaaccauucgaaguuccaaaccccuuaccucucauaguagguuccucgguagguggauuacuacugcuugcauuaauuacagccgcuuuauauaaacuuggauucuuuaagagacaauauaaggauaugaugucugaaggaggaccuccuggcgcagaaccacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4896 - RNA, 1751 nt, Artificial Sequence
  mRNA product Design3 comprising derived and/or modified sequence from Homo sapiens__NP_002415.1__HsMMP8 (opt12)
gggagagucccgcagucggcguccagcggcucugcuuguucgugugugugucguugcaggccuuauucaagcuuaccauguucucacuuaaaacucucccauucuuacuacuacuacacguccaaauaucaaaagccuuccccguauccucaaaagaaaaaaauacuaaaacaguucaagacuaccucgaaaaauucuaccaacuaccuucaaaccaauaccaaucaacaagaaaaaaugguacuaaugucauagucgaaaaauuaaaagaaaugcaaagauuuuuuggacuuaacguuacaggaaaaccuaacgaagaaacccuagacaugaugaaaaaaccacgaugcggagucccagacucaggaggcuucaugcuaacaccaggaaauccaaaaugggaacguacaaacuuaacauaccgcauacgaaacuacaccccacaacuaagugaagcagaaguagaacgcgccauaaaagacgccuucgaacuauggucaguagcaagcccacucauauuuacuagaauaucacaaggugaagcugauaucaauaucgcauuuuaccaacgagaccacggcgauaacucaccauucgacggcccaaauggaauacuagcccacgcauuccaaccaggacaaggaauaggaggugacgcacacuucgacgcagaagaaaccuggacaaacacaucagcaaacuauaacuuauuucuagucgccgcacacgaauucggacacucacuagguuuagcacacucaucagacccaggcgcacuaauguaucccaacuaugcauucagagaaaccucaaauuauucauuaccucaagacgauauagacggaauucaagcaauauauggacuuucuucaaauccaauacaaccaacaggcccuucaaccccaaaacccugugaucccucacuaacauucgacgcaaucacaacucuacgaggagaaauuuuauucuuuaaagacagauauuuuuggagaagacacccacaacuacaaagaguagaaaugaacuucauaagcuuauucuggccaucacuaccaacaggcauucaagcagcauacgaagacuucgauagagaccuaauauucuuauuuaaaggaaaccaauauugggcacuaucagguuacgacauacuacaaggauacccaaaagacauauccaauuauggauucccaucaucaguacaagcaauagacgcagcaguauucuauagaucaaaaaccuacuucuucguaaaugaucaauucuggagauacgacaaccaacgccaauucauggaacccggauaucccaaaucaauaucaggagcauucccaggaauagaaucaaaaguagacgcuguauuccaacaagaacauuucuuucaugucuucuccggacccagguacuacgcauuugauuuaauagcccaaagaguaacacgaguagcaagaggaaauaaaugguugaauuguagauacggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4897 - RNA, 2471 nt, Artificial Sequence
  mRNA product Design3 comprising derived and/or modified sequence from Homo sapiens__NP_004985.2__HsMMP9 (opt12)
gggagagucccgcagucggcguccagcggcucugcuuguucgugugugugucguugcaggccuuauucaagcuuaccaugagccuuuggcaacccuuaguuuuaguuuuacuaguauuaggaugcugcuucgcagcuccuagacaaaggcaaucaacacuuguucucuuuccaggagacuuacgaacaaaucuaacagauagacaacuagcagaagaauacuuauauagauauggauauaccagaguugcagaaaugagaggagaaaguaaaucguuaggaccugcccuacuacuucuucaaaaacaauuaucauuaccagaaacaggagaacuagauucugcuacacuaaaagcaaugagaaccccuagaugcggaguuccagauuuaggccgauuucaaacauuugaaggagaccuaaaauggcaccaucauaauauaacuuauuggauacaaaauuacucugaagacuuaccgagagccguaauagacgaugcauucgcuagagcauuugcuuuauggucagcaguuacaccccuaacauuuacuagaguauauucaagagaugcugauauaguaauucaauuuggagucgcagaacauggugauggauauccauuugauggaaaagacggauuauuagcccacgcauucccaccugguccaggcauucaaggagaugcacauuucgacgaugacgaauuauggagcuuaggaaaaggaguaguaguaccuacacgcuuugggaaugcugauggagcagcaugccauuucccauuuauuuucgaagguagaucauacucugcaugcacuacagauggaagauccgauggauuaccuuggugcagcacaacagcuaauuaugacacugaugacagauuugguuuuuguccauccgaaagacuuuacacacaagacggaaaugcagaugguaaaccaugccaauuuccuuuuauauuucagggacaaucauauucagcuuguacaacagaugggagaagugauggauaccgcuggugugcaaccacugccaauuaugauagagacaagcuauuuggauucuguccuacaagagcagacucgacuguaauggguggaaauucagccggagaacuaugugucuucccauuuacauuuuuagguaaagaauacucuacauguacuucagaaggccguggugauggaagacuuuggugugcaacaacaucaaauuucgacucugacaaaaaauggggauuuuguccagaucaaggauacagcuuauuucuaguugcagcacacgaauuuggacaugcacuagguuuagaucacaguucaguaccagaagcauuaauguauccaauguauagauuuaccgaagggccuccccuucacaaagaugacguuaauggaauaagacacuuauacggacccagaccugaaccugaaccaagaccuccuacuacaacuacuccacaaccaacagccccaccaacaguaugcccaacgggaccgccaacaguacacccaagcgaaagaccaacugcuggaccaacaggaccacccagugcagguccaacugguccaccuacagcaggcccaucuacugcaacaacagucccauuaaguccaguggacgaugcaugcaacguuaacauauucgacgcaauugcagaaauuggaaaucaauuauaucuuuuuaaagauggaaaauacuggagguucucagaaggaagagguucaagaccacaagguccauuucuuauagcugauaaauggccagcucuccccagaaaauuagacucaguauucgaagaacgauuaaguaaaaaauuauucuucuuuucaggcagacaaguuuggguauauacuggugcaaguguacucggaccaagaagacuugauaaauuaggcuuaggggcagacguugcacaaguaacuggagcccuaagauccggucgaggaaaaauguuauuauucucaggaagaagauuauggagauuugauguuaaagcacaaaugguugauccaagaucagcaucagaaguagacagaauguuuccaggcguaccacuagauacucaugacguauuucaauaucgggaaaaagcguacuuuugucaagauagauuuuauuggagaguuucuucaagaucagaauuaaaccaaguagaucaaguuggauauguaacauaugauauccuacaaugcccagaagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4898 - RNA, 1763 nt, Artificial Sequence
  mRNA product Design3 comprising derived and/or modified sequence from Homo sapiens__NP_002418.1__HsMMP13 (opt12)
gggagagucccgcagucggcguccagcggcucugcuuguucgugugugugucguugcaggccuuauucaagcuuaccaugcacccaggaguacuagcagcauucuuauucuuaucuuggacccacuguagagcacuaccucuaccuagcggaggagaugaagaugaccucucagaagaagaccuacaauucgcagaaagauaucuacgaucuuauuaccacccaacaaacuuagcaggaauacuaaaagaaaacgcugcaucaucaaugacagaaagacuaagagaaaugcaaucauuuuucggacuagaaguaacaggaaaauuagacgacaacacauuagacguaaugaaaaaaccaagaugcggaguaccagaugucggagaauacaacgucuucccaagaacauuaaaauggagcaaaaugaaccuaacauauagaauaguaaauuacacacccgacaugacacacucagaaguagaaaaagcauuuaaaaaagcauucaaaguaugguccgaugucacaccccuaaacuucacaagauuacaugacggaauagcagacauaaugauaucuuucggaauaaaagaacacggugacuucuacccuuucgacggaccaucaggacuauuagcacacgcauucccacccggaccaaauuacggaggagaugcacacuuugacgaugaugaaacuuggacaucaucaucaaaagguuauaacuuauuucucguagcugcccacgaauucggacacucacuagggcuagaccacagcaaagaccccggagcauuaauguuuccaauuuauacauauacaggaaaaagucacuuuaugcuaccggacgacgacguacaaggcauacaaucacucuacgguccaggagacgaagacccaaacccaaaacaccccaaaacaccagauaaaugcgacccaucacuaucauuagaugcaauaacaucauuaagaggagaaacuaugauuuucaaagacagauucuucuggagguuacacccccaacaaguagaugcagaacucuuucuaacaaaaucauuuuggccagaauuaccaaauagaauugacgcugcauacgaacacccaucacacgaccuaauauuuauauucagaggaagaaaauucugggccuuaaacggauaugacauacuagaaggauacccaaaaaaaauaucagaauuaggucuacccaaagaaguaaaaaaaauaucagcagccguccacuucgaagacacuggaaaaacauuacucuuuaguggcaaccaaguauggagauaugacgauacaaaccacauaauggauaaagacuacccaagauuaauagaagaagacuuuccaggaauuggagacaaaguagacgccguauacgaaaaaaauggauacauauacuuuuucaacggaccaauucaauucgaauauuccauauggucaaaccgaauaguuaggguaaugccagcaaacuccauauuaugguguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4899 - RNA, 1415 nt, Artificial Sequence
  mRNA product Design3 comprising derived and/or modified sequence from Homo sapiens__NP_001286.1__HsCCR1 (opt12)
gggagagucccgcagucggcguccagcggcucugcuuguucgugugugugucguugcaggccuuauucaagcuuaccauggaaacaccaaauacaacagaagacuaugacacaacuacagaauucgacuauggcgacgccacaccaugccaaaaaguaaacgaaagagcauucggcgcacaauuauuaccaccuuuauacucauuaguauucguaauaggauuaguaggaaacauacuaguaguauuaguacuaguacaauacaaaagacuaaaaaacaugacauccauauaccuacuaaacuuagcaauaucugaccuacuauuccuauucacucuaccauucuggaucgacuauaaacuaaaagaugacuggguuuucggugacgcaaugugcaaaauccucucaggauuuuacuacacaggauuauacagcgaaaucuuuuucaucauacuauuaaccaucgaccgauaccuagccauaguacacgcaguauucgcacucagagccagaacaguaacuuucggcguaauaacaucaauaauaaucugggcauuagccauacucgcaucaaugccaggacuauacuucucaaaaacacaaugggaauucacccaucacacaugcucauuacacuucccucacgaauccuuaagagaauggaaacuauuucaagcccuaaaauuaaacuuauucggacuaguacuaccuuuacuaguaaugauaaucuguuacacaggaauuauaaaaauacuacucagaagacccaacgaaaaaaaaucaaaagccguaagauuaauauucguaauaaugauaauuuucuucuuauucuggacaccauacaacuuaacaauacucauuuccgucuuccaagacuucuuauucacucacgaaugcgaacaaucaagacaucuagaccuagcaguccaagucaccgaaguaauagcauacacacacugcugcguaaacccaguaauuuacgcauucguaggagaacgauucagaaaauaccuuagacaacuuuuucacagaagaguagcaguccaccuugucaaauggcuaccauuuuuaucuguagacagacuagaaagaguaucuucaacaucaccaucuacaggagaacacgaacucucugccggcuuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4900 - RNA, 983 nt, Artificial Sequence
  mRNA product Design3 comprising derived and/or modified sequence from Homo sapiens__NP_002598.4__HsPDGFA (opt12)
gggagagucccgcagucggcguccagcggcucugcuuguucgugugugugucguugcaggccuuauucaagcuuaccaugcgaacacuagccugccuauuacuacuaggaugcggauaccuagcacacguacuagcagaagaagcagaaauaccaagagaaguaauagaaagacuagcaagaucacaaauacacaguauaagagaccuacaaagacuacuagaaauagacucaguaggaucagaagacucacuagacacaucacuaagagcacacggcguacaugcaacaaaacacguacccgaaaaaagaccauuaccaauaagaagaaaaagaagcauagaagaagccguaccagcaguauguaaaacaagaacaguaauauacgaaauaccaagaagccaaguagacccaacaucagccaacuucuuaauauggccaccaugcguagaaguaaaaagaugcacaggaugcugcaacacaagcagcgucaaaugccaaccaaguagaguacaccaucgaucaguaaaaguagcaaaaguagaauacgucagaaaaaaaccaaaacuaaaagaaguacaaguaagacucgaagaacaccuagaaugcgcaugcgccacaacaagccuaaacccagacuacagagaagaagacacaggaagaccaagagaaucaggaaaaaaacgaaaaagaaaaagacuaaaaccaacuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4901 - RNA, 1073 nt, Artificial Sequence
  mRNA product Design3 comprising derived and/or modified sequence from Homo sapiens__NP_002599.1__HsPDGFB (opt12)
gggagagucccgcagucggcguccagcggcucugcuuguucgugugugugucguugcaggccuuauucaagcuuaccaugaacagaugcugggcacuauuccuaucauuaugcuguuacuuaagacuaguaucagcagaaggagauccaauaccagaagaauuauacgaaauguuaagugaucacucaauaagaagcuuugacgauuuacaaagacuacuacauggagauccaggagaagaagacggagcagaacuugaucuaaauaugacaagaucacacaguggaggagaauuagaaucacuagccagaggaagaagaagucuaggaucacucacaaucgcagaaccagcaaugauagcagaauguaaaacaagaacagaagucuucgaaaucucaagacgacuaauagacagaacaaaugcaaacuucuuaguauggccaccaugcguagaaguacaaagaugcucaggaugcugcaauaacaggaacguacaauguagaccaacacaaguacaacuaagacccgugcaaguaagaaaaauagaaauaguaagaaaaaaaccaaucuuuaaaaaagcaacaguaacacuagaagaucaucuagcaugcaaaugcgaaacaguagcagcugcaagaccaguaacaagaucaccaggaggaagccaagaacaaagagcaaaaacgccacaaacaagaguaacaauaagaacaguuagaguaagaagaccaccaaaaggaaaacauagaaaauucaaacacacacacgauaaaacagcauuaaaagaaacauuaggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4902 - RNA, 1385 nt, Artificial Sequence
  mRNA product Design3 comprising derived and/or modified sequence from Homo sapiens__NP_057289.1__HsPDGFC (opt12)
gggagagucccgcagucggcguccagcggcucugcuuguucgugugugugucguugcaggccuuauucaagcuuaccaugucauuauucggauuauuacuuuuaacaucugcauuagcaggacaaagacaaggaacacaagcagaaucaaaccuaucaagcaaauuucaauuuucaucaaauaaagaacaaaauggcguacaagauccacaacacgaaagaauaauaacaguaagcacuaacggaucaauacacagcccccgauucccacauacauacccaagaaacacaguauuaguauggagauuagucgccguagaagaaaauguauggauacaacuuacauucgaugaaagauucggauuagaagaccccgaagacgacauaugcaaauacgacuucguagaaguagaagaacccucagacggaacaauauuaggucguuggugcggaucaggaacaguaccaggaaaacaaauaaguaaaggaaaccaaauaagaauucgauucguaucagaugaauacuuuccaucagaaccaggauucugcauccauuacaauauaguaaugccacaauuuacagaagcaguaucaccaagcguauuaccaccaucagcccuaccucuagacuuauuaaauaacgcaauaacagcauuuagcaccuuagaagacuuaauacgauacuuagaaccagaacgauggcaacuagaccuugaagaccuauacagaccaacauggcaauuacuaggaaaagcauucgucuuuggcagaaaaucaagaguaguagaucuaaaccuacuaacagaagaaguaagauuauacaguugcacaccuagaaacuucucaguaagcauaagagaagaacuaaaaagaacagacaccauauucuggccaggaugccuacuaguuaaaagaugcggaggaaauugcgcauguugcuuacacaacuguaacgaaugccaaugcguacccucaaaaguaacaaaaaaauaccacgaaguacuacaauuaagaccaaaaacaggaguaagaggacuccacaaaucacuuacagacguagcacuagaacaccacgaagaaugugacugcguaugcagaggcucaaccggaggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4903 - RNA, 1442 nt, Artificial Sequence
  mRNA product Design3 comprising derived and/or modified sequence from Homo sapiens__NP_149126.1__HsPDGFD (opt12)
gggagagucccgcagucggcguccagcggcucugcuuguucgugugugugucguugcaggccuuauucaagcuuaccaugcauagauuaauauucguauacacacuaauaugugcaaacuucugcucaugcagagacaccagugcaacaccccaaagcgcaucaauaaaagcacuacgaaacgcaaacuuaagaagagacgaucuauauagaagagaugaaacaauacaaguaaaaggaaacggauacguacaaucaccacgauuuccaaauucauacccacgaaaccuauuauuaacauggcgacuacacucacaagaaaauacaagaauacaacuugucuucgacaaccaauucggacuagaagaagcagaaaaugacauaugcagauaugacuucguagaaguagaagacauaucagaaacuucaacaauaauaagaggaagaugguguggacacaaagaagucccaccaagaauaaaaucaagaacaaaccaaauaaaaauaaccuucaaaucagaugacuacuucguagcaaaaccgggcuuuaaaauauacuauagccuauuagaagacuuccaaccagcagcagcaucagaaaccaacugggaaucaguaacaagcucaauaucuggaguaucauacaacucaccaucaguaacagauccaacacuaauagcagacgcauuagacaaaaaaauagccgaauucgacacaguagaagaucuacuaaaauacuucaacccagaaucauggcaagaagaccuagaaaacauguaccuagacacaccaagauacagaggaagaucauaccaugacagaaaaaguaaaguagaccuagacagacuaaacgacgaugcaaaaagauacagcugcacaccaagaaauuacucaguaaacauaagagaagaacuaaaacuagcaaacguaguauucuucccaagaugcuuauuaguacaaaggugcggaggaaauuguggaugcggaacaguaaacuggagauccuguacaugcaacucaggcaaaacagucaaaaaauaccacgaaguacuacaauucgaaccaggacacauaaaaagaagaggcagagcaaaaacaauggcacuaguagacauacaacucgaucaccacgaaagaugcgacuguauaugcucaagcagaccaccacgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4904 - RNA, 1025 nt, Artificial Sequence
  mRNA product Design3 comprising derived and/or modified sequence from Homo sapiens__NP_003946.3__HsSOCS3 (opt12)
gggagagucccgcagucggcguccagcggcucugcuuguucgugugugugucguugcaggccuuauucaagcuuaccaugguaacacacucaaaauucccagcagcaggaaugucacgaccucuagacacaucauuacgacuaaaaacauucucaucaaaaucugaauaccaacuaguaguaaacgcaguaagaaaauuacaagaaucaggauucuacuggucagcaguaacaggaggagaagcaaaccuacuauuaucagcagaaccagcaggaacauuccuaauaagagacucaucagaccaaagacacuucuuuacacuaucaguaaaaacccaaucuggaacaaaaaaccuacgaauacaaugugaaggaggauccuucucucuacaaucagacccaagaucaacacaaccaguacccagauuugacugcguacuaaaauuaguacaccacuacaugcccccacccggagcaccaucauucccaucacccccaacagaacccucaucagaaguaccagaacaaccaucagcacaaccacuaccaggcucaccaccaagaagagcuuauuacauauacuccggaggagaaaaaauaccacuaguucuaucaagacccuuaucaucaaacguagccacacuacaacaccuaugcagaaaaacaguaaacggacacuuagacucauacgaaaaaguaacacaacuuccaggaccaauaagagaauucuuagaucaauacgacgcaccauuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4905 - RNA, 830 nt, Artificial Sequence
  mRNA product Design3 comprising derived and/or modified sequence from Homo sapiens__NP_003227.1__HsTGFA (opt12)
gggagagucccgcagucggcguccagcggcucugcuuguucgugugugugucguugcaggccuuauucaagcuuaccaugguaccaucagcaggacaauuagcauuauucgcauuaggaauaguauuagcagcaugucaagcauuagaaaauucaacaucaccauuaucagcagacccaccaguagcagcagcaguaguaucacauuuuaaugauugcccagauucacauacacaauucugcuuucauggaacauguagauuuuuaguacaagaagauaaaccagcauguguaugucauucaggauauguaggagcaagaugugaacaugcagauuuauuagccguaguagcagcaucacaaaaaaaacaagcaauaacagcauuaguaguaguaaguauaguagcauuagcagucuuaauaauaacauguguauuaauacauuguugucaaguaagaaaacauugugaauggugcagagcauuaauauguagacaugaaaaaccaucagcacuauuaaaaggaagaacagcauguugucacucagaaacaguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4906 - RNA, 1520 nt, Artificial Sequence
  mRNA product Design3 comprising derived and/or modified sequence from Homo sapiens__NP_000651.3__HsTGFB1 (opt12)
gggagagucccgcagucggcguccagcggcucugcuuguucgugugugugucguugcaggccuuauucaagcuuaccaugccaccaaguggauuaagacuacuaccauuacuauuaccacuauuauggcuacuaguauuaacaccuggaagaccagcugcaggccuaucaaccugcaaaacaauagacauggaacuaguaaaacgaaaaagaauagaagcaauaagaggccaaauacuaucaaaacuaagauuagcaucaccaccuucccaaggagaaguaccaccaggcccacuaccagaagcaguacuagcacuauacaacuccacaagagacagaguagcaggcgaaucagccgaaccagaaccagaaccagaagcugacuacuacgcaaaagaaguaacuagaguauuaaugguagaaacacacaacgaaaucuaugacaaauuuaaacaaucuacacauucuauauauauguucuucaauacaagcgaauuacgagaagcaguacccgaaccaguacuauuaucaagagcugaacuccgauuacuaagauuaaaacuaaaaguagaacaacacguagaacuauaccaaaaauauucuaauaauucauggagauaucuuagcaauagauuacuagcaccauccgacucaccugaauggcuaucauuugauguaacaggaguaguacgucaauggcuaucacgaggcggagaaauagaaggauuuagauuaagcgcucacugcagcugugacucaagagacaacacauuacaaguagacaucaacggauucacaacaggaagaagaggagaucuagccacaauacacggaaugaacagaccauuucuacuauuaauggcaacaccacuagaaagagcacaacaucuacaaucuucaagacacagaagagcauuagacacaaacuacugcuuuucaagcacagaaaaaaauugcugcgucagacaauuauauauagauuucagaaaagauuuaggcuggaaauggauacaugaaccaaaaggauaccacgcaaacuucugccuaggaccaugcccauacauuuggucauuagauacccaauacucaaaaguucuugcauuauacaaccaacacaacccuggagcaagugcagcaccauguugcguaccccaagcauuagaaccacuaccaauaguauauuacguuggccgaaaacccaaaguagaacaacuaucaaacaugauagucagaucauguaaauguucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4907 - RNA, 1592 nt, Artificial Sequence
  mRNA product Design3 comprising derived and/or modified sequence from Homo sapiens__NP_003229.1__HsTGFB2 (opt12)
gggagagucccgcagucggcguccagcggcucugcuuguucgugugugugucguugcaggccuuauucaagcuuaccaugcacuacugcguacucucagccuuccuaauacuacaccuaguaacaguagcauuaagcuuaucaacaugcucaacacuagacauggaucaauucaugagaaaaagaauagaagcaauaagaggccaaauacuaucaaaacuuaaauuaacaucaccaccagaagacuaucccgaaccagaagaaguaccaccagaaguaauaucaauauauaacucaacaagagaccuauuacaagaaaaagcaagccgaagagcagcagcaugcgaacgagaaaggucagacgaagaauacuacgccaaagaaguauacaaaauagacaugccacccuucuucccaucagaaaaugccauaccccccacauuuuacagaccauacuucagaaucguaagauucgacguaucagcaauggaaaaaaacgcaucaaaucuaguuaaagcagaauucagaguauucagacuacaaaacccaaaagcaagaguaccagaacaaagaauagaacuauaccaaauacuuaaauccaaagaucuaacaucaccuacacaaagauauauagacucaaaaguaguaaaaacuagagcagaaggcgaauggcuauccuucgacguaacagacgccguucacgaauggcuucaccacaaagaccgaaacuuaggauucaaaauaucacuucacuguccauguugcacauuuguccccucaaauaacuacauaauccccaauaaaucagaagaacucgaagcaagauucgccggaauagacggaacuagcacauauaccuccggagaccaaaaaaccauaaaaucuacaagaaaaaaaaacucuggaaaaacaccacacuuacuauuaaugcuacuacccucauaccgacucgaaucucaacaaacaaacagacgaaaaaaaagagcauuagacgccgcuuauuguuucagaaauguacaagauaacugcugccuacgaccacuauacauagauuucaaaagagaucuaggcuggaaauggauccaugaaccaaaaggcuauaacgcaaacuucugcgcuggagcaugcccauaccuauggucaucagacacacaacauucaagaguauuaucacuuuacaacaccauaaaucccgaagcaucagcaagccccuguugcguaucacaagaccuagaaccacuaaccauccuauacuauauaggaaaaacuccaaaaauagaacaacuaucuaauaugauaguaaaaucaugcaaaugcucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4908 - RNA, 1586 nt, Artificial Sequence
  mRNA product Design3 comprising derived and/or modified sequence from Homo sapiens__NP_003230.1__HsTGFB3 (opt12)
gggagagucccgcagucggcguccagcggcucugcuuguucgugugugugucguugcaggccuuauucaagcuuaccaugaaaaugcacuuacaaagagcccuaguaguccuagcuuuacuuaacuucgcaaccguaucccuaagccuaucaacuuguacaacccuagacuuuggacacauaaaaaaaaaacgcguagaagcaauuagaggacaaauauuaucuaaacuaagauuaaccucaccaccagaaccaacaguaaugacacauguaccauaccagguauuagcacuauacaauucaacacgcgaacuacuagaggaaaugcauggagaaagagaagaaggaugcacacaagaaaacacagaaucagaauacuacgcaaaagaaauccauaaauucgacaugauacaaggauuagcagaacacaacgaacuagcaguaugcccaaaaggaauaacaucaaaaguauuuagauucaauguaucuucaguugaaaaaaauagaacuaaccucuuuagagccgaauuccgcguauuaagaguccccaacccaagcagcaaacgaaacgaacaaagaauagaacuauuccaaauacuaaggccagacgaacacauagcaaaacaaagauauauaggaggcaaaaauuuacccacaagagguacagcagaauggcuaucauucgauguaacagauaccguaagagaauggcuacuaagaagagaaaguaaucuaggccuagaaauaucaauacauuguccaugucacacauuccaaccaaacggagacauauuagaaaacauacacgaaguaauggaaauaaaauucaaaggaguagacaacgaagaugaucacggacgaggcgaucuaggcagauuaaaaaaacaaaaagaccaccacaauccacaccuaauauuaaugaugauaccaccacacagacuagacaauccaggccagggaggccaaagaaaaaaaagggcacuagacaccaacuacugcuucagaaaccuagaagaaaacugcugcguaagaccacuauacauugacuucagacaagaccuaggcuggaaauggguccaugaaccaaaaggauacuacgccaacuuuugcucaggaccaugcccauaccucagaucagcagacacaacccacucaacaguauuagguuuauacaacacauuaaacccagaagcaagugccuccccuuguugcguaccacaagaccuagaaccauuaaccauauuauauuauguaggacgaacaccaaaaguagaacaacuaucaaauaugguaguaaaaucaugcaaauguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4909 - RNA, 1733 nt, Artificial Sequence
  mRNA product Design3 comprising derived and/or modified sequence from Homo sapiens__NP_001057.1__HsTNFRSF1B (opt12)
gggagagucccgcagucggcguccagcggcucugcuuguucgugugugugucguugcaggccuuauucaagcuuaccauggcuccuguagccguaugggcagcucuagccguaggauuagaauuaugggcugcugcccaugcacuaccugcccaaguugcuuuuacaccauacgcaccagaaccugguucaacauguagauuaagagaauauuaugaucaaacugcucaaauguguuguucaaaauguagcccuggucaacaugccaaaguauucuguacuaaaacuucugauaccguaugugauucaugugaggauucaacauauacacaauuauggaauuggguaccagaauguuuaucauguggaucucgauguucaucagaucaaguagaaacacaagcuuguacaagagaacaaaauagaauauguacuuguagaccagguugguacugcgccuuaucaaaacaagaaggauguagacuaugcgccccacuacgaaaauguagaccaggauuugguguugcacguccaggaacagaaacaucagacguaguauguaaaccaugcgcucccgguacauucucaaauacaacaucauccaccgauauaugucgaccacaucaaauauguaauguaguagcaauaccaggaaaugcaucuauggacgcaguauguacaucaacaucacccacaagaucaauggcaccaggugcuguccaucuaccacaaccuguuucaacaagaucacaacauacacaaccuacacccgaaccauccacagcaccaaguaccucauuucuuuuaccuaugggaccaucaccaccugcagaaggaucaacaggagauuuugcacuuccaguaggacuaauaguuggaguaacugcacuaggauuauuaauaauuggagucguaaauuguguaauaaugacacaaguaaaaaaaaaaccauuaugcuuacaacgagaagccaaagucccucauuuaccagcagacaaagcuagaggaacccaaggaccagaacaacaacaccuacucauaaccgcaccuucaucaucuucaucaucuuuagaaucaucugcaucugcauuagauagaagagcacccacaagaaaucaaccacaagcaccuggaguugaagcuuccggggcaggugaagcucgagcuucaacaggaucuucagauucaucuccagguggucauggaacccaaguuaauguaacuugcaucguaaauguauguucaucaucagaucacucaucacaauguucaucacaagcaaguucaacuaugggagauacugacucaagcccaucggaaucaccuaaagaugaacaaguaccauuuaguaaagaagaaugugcauuuagaucucaacuugaaacaccagaaacuuuauuaggaaguacagaagaaaaaccacuaccauuaggaguacccgaugcagggaugaaaccuuccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4910 - RNA, 860 nt, Artificial Sequence
  mRNA product Design3 comprising derived and/or modified sequence from Homo sapiens__NP_002623.2__HsPGF (opt12)
gggagagucccgcagucggcguccagcggcucugcuuguucgugugugugucguugcaggccuuauucaagcuuaccaugccaguaaugaggcuauuuccauguuuuuuacaauuacuagcaggauuagcauuaccagcaguaccaccacaacaaugggcauuaagugcaggaaauggaaguucagaaguagaaguaguaccauuucaagaaguauggggaagaucauauuguagagcacuugaaagauuaguagauguaguaagugaauauccaagcgaaguagaacauauguuuucaccaucauguguaaguuuauuaagauguacaggauguuguggagaugaaaaucuacauuguguaccaguagaaacagcaaauguaacaaugcaauuacuaaaaauaagaaguggagauagaccaucauauguagaauuaacauucagucaacauguaagaugugaauguagaccauuaagagaaaaaaugaaaccagaaagaagaagaccaaaaggaagaggaaaaagaagaagagaaaaacaaagaccaacagauugccauuuauguggagaugcaguaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4911 - RNA, 1586 nt, Artificial Sequence
  mRNA product Design3 comprising derived and/or modified sequence from Homo sapiens__NP_001020537.2__HsVEGFA (opt12)
gggagagucccgcagucggcguccagcggcucugcuuguucgugugugugucguugcaggccuuauucaagcuuaccaugacagacagacaaacagauacagcaccuucaccaagcuaucacuuauuaccugguagaagaagaacaguagaugcagcagcuaguaggggacaaggaccagaaccagcuccaggaggagguguagaaggaguaggggcaagaggaguagcuuuaaaauuauuuguacaacuuuuaggauguagcagguuuggaggagcgguuguaagagccggugaagcagaaccgucaggagcagcaagaucagcaagcucaggaagggaagaaccacaaccagaagaaggugaagaagaagaagaaaaggaagaagaaaggggaccacaauggcgacugggagcaagaaagccagguaguuggacaggagaagcagcaguaugcgcagacucugcaccagcagcaagagcaccgcaagcauuagcucgagcaaguggaaggggaggaagaguagcucgaagaggagcagaagaaucaggaccuccacacaguccaaguaggagaggaagugcaagcagggcaggaccagggagagcaagcgaaacaaugaauuuucuauugaguuggguacauuggagccuagcccuauuauuauauuuacaucaugcuaaauggucacaagcagcaccaauggcagaaggaggaggacaaaaucaucaugagguagugaaauuuauggauguauaucaaagaucauauugucauccaauagaaacauuaguugacauauuucaagaauauccagaugaaauagaauauaucuuuaaaccuagcugugucccauugaugagauguggaggauguuguaaugaugagggauuagaaugcguaccaacagaagaaaguaacauaacaaugcaaauaaugcgaauaaaaccacaucaaggacaacauauaggagaaaugucauuuuugcaacauaacaaaugcgaaugcaggccaaaaaaagacagagcaagacaagaaaaaaaaaguguuagaggaaaaggaaaaggucaaaaaaggaaaagaaaaaaaaguagauauaaaaguuggaguguauauguaggagcaagauguuguuuaaugccauggagucuaccgggaccacauccauguggaccuugcagugagaggagaaaacacuuauuuguucaagacccacaaacauguaaauguucuuguaaaaacacugauagcagauguaaagcucgacaauuggaauuaaaugaaaggacauguagaugugauaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4912 - RNA, 1046 nt, Artificial Sequence
  mRNA product Design3 comprising derived and/or modified sequence from Homo sapiens__NP_001165094.1__HsVEGFA (opt12)
gggagagucccgcagucggcguccagcggcucugcuuguucgugugugugucguugcaggccuuauucaagcuuaccaugaacuuccuauuaagcuggguacacuggucacuagcauuauuauuauauuuacaucacgccaaauggucacaagcagcaccaauggcagaaggaggaggacaaaaccaccacgaaguaguaaaauuuauggauguauaccaaagaagcuauugccauccaauagaaacacuaguagacauauuccaagaauauccagaugaaauagaauauauauuuaaaccauccugcguaccauuaaugagaugcggaggaugcugcaacgacgaaggacuagaaugcguaccaacagaagaaaguaauauaacaaugcaaauaaugagaauaaaaccacaccaaggacaacacauaggcgaaaugaguuucuuacaacauaacaaaugcgaaugcagaccaaaaaaagacagagcaagacaagaaaaaaaaagcguaagaggaaaaggaaaaggacaaaaaagaaaaagaaaaaaaagcagauacaaaagcuggagcguauacguaggagcaagaugcugcuuaaugccauggucacuaccaggaccacacccaugcggaccauguucagaaagaagaaaacaucuauuuguacaagacccacaaacauguaaaugcucaugcaaaaacaccgacaguagauguaaagcaagacaacuagaacuaaaugaaagaaccuguagaugugacaaaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4913 - RNA, 971 nt, Artificial Sequence
  mRNA product Design3 comprising derived and/or modified sequence from Homo sapiens__NP_003368.1__HsVEGFB (opt12)
gggagagucccgcagucggcguccagcggcucugcuuguucgugugugugucguugcaggccuuauucaagcuuaccaugucaccacuauuaagaagacuacuauuagcagcauuacuacaacuagcaccagcacaagcuccaguaagccaaccagacgcacccggacaucaaagaaaaguaguaucauggauagauguauacacaagagcaacaugucaaccaagagaaguuguagucccacuaacaguagaauuaaugggaacaguagcaaaacaauuaguaccaucaugcguaaccguacaaagaugcggaggauguugcccagacgauggcuuagaaugcguaccaacuggacaacaucaaguaagaaugcaaauacuaaugauaagauacccaucaucacaauuaggagaaaugucauuagaagaacauucacaaugcgaaugcagaccaaaaaaaaaagacucagcaguaaaaccagacagagcagcaacaccacaucauagaccacaaccaagaucaguaccaggaugggacucagcaccaggagcaccaucuccagcagacauaacacauccaacaccagcaccaggaccaucagcacaugcagcacccucaacaacaagugcacuaacaccaggaccagcagcagcagcagcugacgcagcagcaucaucagucgcaaaaggaggagccuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4914 - RNA, 1607 nt, Artificial Sequence
  mRNA product Design3 comprising derived and/or modified sequence from Homo sapiens__NP_005420.1__HsVEGFC (opt12)
gggagagucccgcagucggcguccagcggcucugcuuguucgugugugugucguugcaggccuuauucaagcuuaccaugcaccuauuaggauucuuuagcguagcgugcaguuuauuggcagcagcacuauuaccagguccacgugaagcaccagccgcagccgcagcuuucgaaucaggauuagacuuaagcgacgcugaacccgacgcaggcgaagcaacagcauacgcuucaaaagaucuagaagaacaacuaagaucuguaucuucaguagacgaauuaaugacaguacuauacccagaauauuggaaaauguauaaaugccaacuaagaaaaggagguuggcaacacaauagagaacaagcaaacuuaaacuccagaacagaagagacuauaaaauuugcagcagcacauuacaacacagaaauucuaaaaucaauagacaaugaauggagaaaaacucaauguaugccaagagaaguaugcauagacguagguaaagaauucgguguagccaccaacacauuuuuuaaaccaccaugcguaucaguauauagaugcggaggcuguugcaauucagaaggauuacaauguaugaauaccucuacaagcuaccuaucaaaaacacuauucgaaauaacuguaccauuaucacaaggaccaaaaccaguaacaauaucauuugcaaaccacacaucaugucgaugcaugucaaaauuagacguauaccgacaaguacacaguauaauaagaagaucacuacccgcaacacuaccacaaugccaagcagcaaauaaaacaugcccaacuaacuacauguggaauaaucauauuuguagaugccuagcacaagaagauuucauguucucaagugaugcaggugacgacucuacugacggauuucaugacauauguggaccaaauaaagaacuagacgaagaaacaugucaaugcguaugcagagcaggacuucgaccagcauccugugguccacauaaagaacuagauagaaauucaugccaauguguuuguaaaaauaaauuauuccccagccaaugcggagcaaauagagaauuugaugaaaauacaugccaauguguauguaaaagaaccugcccaagaaaucaaccacuaaacccaggaaaaugcgccugcgaaugcacagaaaguccacaaaaaugucuauuaaaagguaaaaaauuccaucaccaaacauguucaugcuacagaagaccaugcacaaacagacaaaaagcaugugaaccuggauuuucauauucagaagaaguuuguagauguguuccaucauacuggaaacgaccacaaaugagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4915 - RNA, 1412 nt, Artificial Sequence
  mRNA product Design3 comprising derived and/or modified sequence from Homo sapiens__NP_004460.1__HsVEGFD (opt12)
gggagagucccgcagucggcguccagcggcucugcuuguucgugugugugucguugcaggccuuauucaagcuuaccauguacagagaauggguaguaguaaacguauucaugaugcuauauguacaacuuguacaaggaagcucaaaugaacacggaccaguaaaaagaucaucacaguccacacuagaaagaucagaacaacaaauaagagcagcauccucucuagaagaauuacuaagaaucacacauuccgaagacuggaaauuauggcgaugucgacuacgcuuaaaaagcuuuacuaguauggacucacgcucagcaucacauagaaguacaagauuugcagcaacauucuacgacauagaaacacuaaaaguaauagaugaagaauggcaaagaacacaaugcucaccaagagaaacaugcgucgaaguagcaucugaacucggaaaauccaccaauacauucuucaaaccaccaugcguuaacguauuuagaugcggaggauguugcaacgaagaaucacuaauaugcaugaauacauccacaucauacauaucaaaacaacuauucgaaauauccguaccauuaacaucaguaccagaacuaguaccaguaaaaguagcaaaucacacaggaugcaaaugccuaccaacagcaccaagacacccuuacagcauaauaagaagaucaauacaaauacccgaagaagacagaugcucccacagcaaaaaauuaugcccaaucgacaugcuaugggacucaaacaaaugcaaaugcguacuacaagaagaaaacccacuagcagguacagaagaccacucacaccuacaagaaccagcauuaugcgguccucacaugauguucgacgaagauagaugcgaaugcguaugcaaaacaccauguccaaaagacuuaauacaacacccaaaaaauugcuccuguuuugaauguaaagaaucacuagaaacaugcugccaaaaacacaaauuauuucaucccgauacaugcucaugcgaagacagaugcccauuccacacaagaccaugcgcaaguggaaaaacagccugcgccaagcacugccgauucccaaaagaaaaaagagcagcucaaggaccacacucacgaaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4916 - RNA, 977 nt, Artificial Sequence
  mRNA product Design3 comprising derived and/or modified sequence from Homo sapiens__NP_061986.1__HsFGF21 (opt13)
gggagagucccgcagucggcguccagcggcucugcuuguucgugugugugucguugcaggccuuauucaagcuuaccauggacucagacgaaacagguuucgaacacuccggauuauggguaucaguauuagcaggauuacuauuaggagcaugccaagcacauccaauaccagacucaucaccacuucuacaauucggaggacaaguaagacaaagauacuuauacacagaugacgcccaacaaacagaagcacacuuagaaauaagagaagacggcacagucggaggagcagcagaccaaucaccagaaucuuuauuacaauuaaaagcauuaaaaccaggaguaauacaaauauuaggaguaaaaacaucaagauuucuaugccaaagaccagacggagcauuauacggaucauuacauuucgacccagaagcauguucauucagagaauuauuacuagaagaugguuauaauguauaucaaucugaagcacacggauuaccacuacaucuaccaggaaauaaaucaccacauagagacccagcaccaagaggaccagcaagauucuuaccauuacccggauuaccuccagcacuaccugaaccaccaggaauacuagcaccacaaccaccagauguaggaucauccgacccauuaucaaugguaggaccaucacaaggaagaaguccaucauacgcaucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4917 - RNA, 1757 nt, Artificial Sequence
  mRNA product Design3 comprising derived and/or modified sequence from Homo sapiens__NP_002412.1__HsMMP1 (opt13)
gggagagucccgcagucggcguccagcggcucugcuuguucgugugugugucguugcaggccuuauucaagcuuaccaugcacucauucccuccacuauuauuauuacuauuuuggggaguaguaucacacaguuucccugcaaccuuagaaacacaagaacaagacguagaccuaguucaaaaauacuuggaaaaauacuacaaccuuaaaaaugacggaagacaaguagaaaaacgaagaaauucaggaccagucguagaaaaacuaaaacaaaugcaagaauuuuucggacuaaaaguuacaggaaaaccagaugcagaaacacuaaaaguaaugaaacaaccuagauguggaguacccgacguagcccaauuuguauuaacagaaggcaacccaagaugggaacaaacccacuuaaccuacagaauagaaaauuacacaccagaucuaccuagagccgacguagaucaugcgauagaaaaagcauuucaauuauggaguaauguaacuccacuaacauuuacaaaagucucagaaggacaagcggacauaaugauauccuucguaagaggagaucacagagacaauaguccauucgacggaccaggcggaaaccuagcacacgcuuuccaaccaggacccggcauaggaggagaugcacacuucgacgaagacgaaagauggacaaacaacuucagagaauauaaccuccacagaguagcugcacaugaacuaggacauucauuaggacuuagccacagcacagacauaggagcacuaauguacccuucauauacauuuucaggagacguacaauuagcacaagacgauauagacggaauacaagcaauauauggaagaucacaaaauccuguacaaccgaucggaccucagacaccaaaagcaugcgauagcaaacuuaccuucgacgcuauaacaacaauuagaggcgaaguaauguucuucaaagaccgauuuuacaugagaacaaauccauucuaucccgaaguagaauuaaacuuuauauccguauuuuggccacaacucccuaacggauuagaagccgcauacgaauuugcagauagagacgaaguaagauuuuucaaaggaaacaaauacugggcuguacaaggacaaaacguacuacacggauauccaaaagacauauacucaucauucggcuuuccccgaacaguaaaacauauagaugcagcauuaucagaagaaaacacaggaaaaacauauuucuuuguagccaacaaauacuggagauaugaugaauacaaaagaucaauggacccagguuacccaaaaaugauagcacaugauuuuccaggaauuggacauaaagucgacgccgucuucaugaaagacggauucuucuauuucuuucauggaacuagacaauauaaauucgacccaaaaacaaaaagaauauuaacacuacaaaaagcaaacucuugguucaacuguaggaaaaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4918 - RNA, 1517 nt, Artificial Sequence
  mRNA product Design3 comprising derived and/or modified sequence from Homo sapiens__NP_002412.1__HsMMP1(1-19,100-469) (opt13)
gggagagucccgcagucggcguccagcggcucugcuuguucgugugugugucguugcaggccuuauucaagcuuaccaugcacucauuuccaccauuacuacucuuauuauuuuggggaguaguaucacacucauucguacuaacagaaggaaauccaagaugggaacaaacacaccuuaccuacagaauagaaaauuacacaccagaucuaccaagagcagacguagaccacgcaauagaaaaagcauuucaauuauggucaaacguaacaccauuaacauucacaaaaguaucagaaggacaagcagacauaaugauaucauucguaagaggagaccacagagacaauucaccauuugauggaccaggagguaaucuggcacacgcauuccaaccaggaccaggaauaggaggagacgcacacuucgacgaagacgaaagauggacaaacaacuucagagaauacaaccuacacagaguagcagcccaugaacuaggacacucacuaggacuaucacacucaacagacauaggagcccuaauguauccauccuacacauucucaggagacguacaacucgcgcaagacgacauugacggaauccaagcuauauacggaagaucacaaaacccaguacaaccaauaggcccccaaacaccaaaagcaugugacucaaaacuaacauuugaugcaauaacaacaauaagaggcgaaguaauguucuucaaagacagauucuacaugcgcacaaauccauucuacccagaagucgaauuaaacuucauaucaguauucuggccccaauuaccaaacggauuagaagccgccuacgaauuugcagaccgagacgaaguaagauucuucaaaggaaacaaauauugggcaguacaaggacaaaacguauuacacggauauccaaaagacauauacuccucauuuggcuuuccaagaacaguaaaacauaucgacgcagcacucuccgaagaaaacacaggaaaaacauacuucuuuguagcaaacaaauacuggagauaugacgaauauaaaagaucaauggacccgggauacccaaaaaugauagcacaugacuucccaggaauaggacacaaaguagacgccguauucaugaaagacggauuuuucuacuucuuucacggaacuagacaauacaaauucgacccaaaaacaaaaaggauacuaacauuacaaaaagcaaacucaugguuuaacugccgcaaaaacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4919 - RNA, 3704 nt, Artificial Sequence
  mRNA product Design3 comprising derived and/or modified sequence from Clostridium histolyticum__BAA77453.1__ColG (opt13)
gggagagucccgcagucggcguccagcggcucugcuuguucgugugugugucguugcaggccuuauucaagcuuaccaugaagaaaaauauacuuaaaauacucauggacucauacaguaaagaaagcaaaauucaaacgguucgaagaguaaccagugucagccuauuagcaguauaucuaacuaugaauacuagcagcuuaguacucgcgaaaccaauugaaaauacaaaugacacaaguauuaaaaauguagaaaaauugagaaaugcaccaaaugaagaaaacucgaagaaaguagaagauagcaaaaaugauaaaguugagcauguuaaaaacauagaagaagcaaaagucgaacagguggcuccagaaguaaaaucaaaaagcacacucagaucagcaaguaucgcaaacacgaacagugagaaauaugauuuugaauaccugaauggccucucauauacagaauuaacaaacuuaauuaaaaauauaaaauggaaucaaaucaacggcuuauucaauuacaguaccggaagucagaaauucuuuggggacaaaaaccgaguacaagcaauaauuaaugcauuacaagaaucagggcgaacauauacagccaacgauaugaaaggaauugaaacauucaccgagguuuuacgagcuggcuucuauuugggcuacuacaacgauggacuauccuauuugaacgauagaaacuuucaggauaaauguauaccagcaaugaucgcaauacagaagaacccaaacuucaaauuaggaacagcaguacaagaugaaguaauuaccagucuugguaaauuaauuggaaacgcaagcgcgaaugcugaaguuguaaauaacugugucccagucuuaaaacaauuuagagagaauuuaaaucaauaugcaccagauuacguuaaaggaacagcgguuaaugaauuaauaaaaggaauagaguucgacuuuagcggagcagcuuacgaaaaagacguaaaaacuaugccuugguacggaaagauugauccauucauaaacgaauuaaaagcauugggccucuacggaaauauaacaucagcuacagaaugggccagcgauguggguauauacuaucuuaguaaauucggucuuuauaguacaaacaggaaugauaucguucaaucacuagaaaaagcaguagauauguauaaauacggaaaaauagcauuuguggcaauggaaagaauaacaugggacuaugauggaauaggaucuaacggcaagaaaguagaccaugacaaauuucucgacgaugccgaaaaacacuacuuaccaaaaacguauacauuugacaauggaacauuuaucauaagagcgggugacaaaguaagugaagagaaaauaaaaagacuauacugggcaucuagagaaguaaaaucucaauuucacagggucgucgggaaugacaaagcacuagaaguaggaaacgccgacgauguccucacaaugaaaauauucaacagccccgaagaauauaaauucaauacuaauauaaauggaguuagcacagacaauggcggauuauauauagaaccacgagggacuuucuacacguaugaaagaacaccacaacaaucaauauucagcuuagaagaacuguuuagacaugaauauacucauuacuuacaagcucgauauuuaguggauggauuauggggacaaggccccuucuacgagaaaaacagacuaacuugguucgacgaaggaacagcagaguucuucgccggcucaaccaggacaucaggagugcuuccgagaaaaucaauacuaggcuaucuugcaaaagauaaaguagaccacagauacagccucaagaaaacauuaaauucaggauaugaugauagcgauuggauguuuuauaauuauggguuugcuguagcccacuauuuauaugaaaaagauaugccaacauuuauaaaaaugaauaaagcaauucuaaauaccgacguuaaaagcuaugaugaaauaauaaagaaauuaucagacgacgcgaacaaaaacacagaauaucaaaaucacauacaagaauuagccgacaaauaucaaggagcaggcauacccuuagugucagacgacuauuuaaaagaucauggauauaagaaagcguccgaaguauauucugaaauaucuaaagcggcaagccuaacaaauacauccguaacagcggaaaaaucacaauacuuuaauacauuuacacuaagaggaacauauacaggagaaacaaguaaaggcgaauuuaaagacugggacgaaaugagcaagaaacuggacggaacacuagaaagccuagcuaaaaacucauggagcggauauaaaacauuaacggcauauuuuaccaauuaccgaguaacguccgacaacaaaguacaauaugacguuguauuucacggcguuuuaacagauaacgcagauauaaguaauaacaaagcaccaauagcaaaaguuacaggcccaucgacaggugccguagguagaaacauugaauuuucuggaaaagauucaaaagaugaagauggaaaaaucguaucauacgacugggacuuuggagacggagcaacaucaagagggaaaaauucaguccaugcauacaagaaagcuggaacauauaacguaacauuaaaaguuaccgaugauaaaggugcgacagcaacugaaucuuuuacaaucgaaaucaaaaacgaagauacaacaacaccaauaacgaaagaaauggaacccaaugacgauauaaaagaagcuaauggaccaauagucgaaggaguaaccgucaaaggugaccuaaacggcuccgacgacgcugauacauucuauuuugauguuaaagaagauggagaugugacaauagaacuaccauauucaggaucuaguaacuuuaccuggcugguauauaaagaaggcgaugaucaaaaucauaucgcuagugguauagacaaaaauaacagcaaaguuggaacauuuaaaagcacaaaagguagacauuacguauucauuuacaaacacgauucagcaucaaauaucucauacucuuuaaauauaaaaggcuuagguaaugaaaaacugaaagagaaagaaaauaaugauucgucagacaaagcuacagugauaccaaauuucaauacaacuaugcaaggaucacugcuaggagaugacagccgugauuauuacagcuucgaaguaaaagaagaaggagagguaaacaucgaauuagauaagaaagaugaauuuggaguaacauggacauuacauccagaauccaacauaaacgacagaauaacauacggacaaguugaugguaacaaaguaaguaauaaaguaaaauugaggccuggaaaauacuaccuguuaguauauaaauacagugggucaggaaacuacgaacuacgaguuaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4920 - RNA, 3428 nt, Artificial Sequence
  mRNA product Design3 comprising derived and/or modified sequence from Clostridium histolyticum__BAA77453.1__HsALB(1-18)_ColG(111-1118) (opt13)
gggagagucccgcagucggcguccagcggcucugcuuguucgugugugugucguugcaggccuuauucaagcuuaccaugaaauggguaacuuuuauaagucuucuauuucuauuuucaucggcauauaguauagcaaacacaaacucagaaaaauaugacuuugaauaucuaaauggauuaucauauacagaauuaacaaaccugaucaaaaacauaaaauggaaucaaauaaacggauuauuuaacuauagcacgggaucacagaaauuuuucggcgauaaaaauagaguacaagcaauuauaaaugcucuccaagaaucuggcagaacguauacagcaaacgauaugaaaggaaucgaaacuuuuacagaaguccugagagcagguuuuuacuuagguuauuacaacgacgggcuaagcuaucuaaaugauagaaacuuccaagacaaauguauaccagcaaugauugcaauacagaaaaaccccaauuuuaaauuaggaacagcaguucaagacgaaguuauaacaucucuuggcaaacuuauagggaacgcaagcgcaaacgcagaaguaguaaacaacuguguaccgguauuaaaacaauucagagaaaauuuaaaucaauacgcaccagacuauguaaaaggaacagcaguaaacgaacuaauaaaaggaauagaauuugauuucagcggagccgcauaugaaaaggaugucaaaacuaugccgugguacggaaaaauagacccauuuauaaaugaacuuaaagcacuagguuuauacggaaacaucacaagcgcaacugaaugggcaucagauguuggaauuuauuaccuaucuaaauuuggacuauacucaaccaacaggaacgauauagugcaaucucuggaaaaagcuguagacauguauaaauauggaaaaauagcuuucgucgcaauggaaagaauaacuugggauuaugaugguauuggaucaaacggcaaaaagguagaucacgauaaauucuuagaugacgcagaaaagcacuacuuaccaaaaacguauacauucgacaacgggacuuuuauaaucagagcaggcgauaaaguauccgaagagaaaauaaaaagauuauacugggcuucaagggaaguaaaaucucaauuccaccgaguaguaggaaaugauaaagcauuagaaguggguaacgcugaugauguauuaacaaugaaaauauucaacagcccugaagaauacaaguucaauacaaauauaaacggagucucuaccgauaacggaggcuuauacauugaaccaagaggaacauuuuacacauaugaaagaacuccacaacaaagcauauucagccuugaggaacuauuccgacacgaauauacacauuacuuacaagccagguaucuuguagauggacuuuggggacagggaccuuucuaugaaaagaauagacuaaccugguucgacgaaggaacagcagaguucuuugcagguucaacaagaacaucuggaguauuaccacgaaaaucaauucucgguuauuuagcaaaagauaaaguagaucauagauauucacuaaagaaaaccuugaacucaggauacgacgacagugacuggauguucuacaauuacggauuugcaguagcacacuauuuauaugaaaaagauaugccuacauucauuaaaaugaacaaagcaauacuaaauaccgaugugaaaagcuaugacgaaauaauaaagaaacuuucagacgaugcgaacaaaaauacagaauaccaaaaccauauucaagaacucgccgacaaauaccaaggugcaggcauuccucuaguaagugacgacuauuuaaaagaccauggauacaagaaagcaucagaagucuauucagaaaucagcaaagccgcauccuuaacuaauacaagcgucacagcagagaaaucacaauacuuuaauacauucacgcuucgaggaacuuauacaggugaaacgucaaaaggagaguuuaaagauugggaugaaaugucaaagaaauuagauggaacacuagaaucguuagcuaaaaacucauggucuggauauaaaacacuaaccgcauacuuuacuaacuacagaguuaccagugauaacaaaguacaauacgauguaguauuucauggaguacuaacagacaaugcagacauuagcaauaacaaagcaccaauagcaaaaguuaccggccccucaacaggggcaguagguagaaauauugaguucucuggaaaagauagcaaagaugaagauggaaaaauaguuucauaugauugggacuuuggugauggagcaacuagcaggggcaaaaacucaguucacgcauacaagaaagcaggaacauauaacguaaccuuaaaaguaaccgaugauaaaggagcaaccgccaccgaaaguuuuacuauagaaaucaaaaacgaagacacaacgacaccaauaacaaaagaaauggaaccaaaugacgacauaaaagaagcaaacggaccaauaguagaaggaguaacaguaaaaggagaccuaaauggcucggacgaugcagauacauuuuacuuugaugucaaagaggauggugacguaaccauagaacuacccuauagcggaucaaguaauuucacuuggcuaguuuacaaagaaggagaugaccaaaaccauauugcaucaggaauugauaaaaacaacucaaaaguaggcacauucaaaucaacaaaaggacgacauuacguuuucauauauaaacacgacagcgcuucaaacauaucauauucucucaacauaaaagguuuaggcaaugaaaaauuaaaagaaaaagaaaauaacgacucaucagauaaagcaaccguaaucccaaauuucaauacaacgaugcaaggaucgcuccucggagaugacagucgugauuacuacucauuugaaguaaaagaagaaggagaaguuaauauagaacuagauaagaaagacgaguucggaguaacauggacauuacacccagagaguaauaucaacgauagaauuacauauggccaaguugacggaaauaaaguuaguaauaaaguaaaacuuaggccaggaaaauauuaccugcucgucuacaaauacucagguagcgguaacuaugaacuaagaguaaacaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4921 - RNA, 3776 nt, Artificial Sequence
  mRNA product Design3 comprising derived and/or modified sequence from Clostridium histolyticum__BAA77453.1__HsALB(1-18)_ColG(1-110)_CS-F_ColG(111-1 118) (opt13)
gggagagucccgcagucggcguccagcggcucugcuuguucgugugugugucguugcaggccuuauucaagcuuaccaugaaauggguaacauucauuagccucuuauuucuauuuucaucagcauacaguaugaagaaaaauauacuaaaaauauugauggacuccuauaguaaagagagcaaaauacaaacaguaaggcgaguaaccagcgugaguuuacuugcuguauaucuaacaaugaacacaaguagccuaguuuuagcaaaaccaauagaaaauacgaaugauaccuccaucaaaaacguagaaaaacuaagaaaugcaccaaacgaagaaaauucaaagaaaguagaagauaguaaaaacgacaaaguagaacaugugaaaaacauagaagaagccaaaguagaacaaguagcaccagaagucaaaucuaaauccacuuuaagaagugcgucaaggagaagaagaaaaagaauagcaaacacaaauagugaaaaauacgauuucgaauaccuaaacggacuauccuauacugaacuaacaaaucuaauuaaaaacauaaaauggaaucaaauaaacgguuuauuuaacuauuccacaggcucacaaaaauuuuucggagauaaaaaucgcguucaagcaauaauaaaugcccuacaagaaagcgggagaaccuacaccgcaaaugauaugaaaggaauagaaacauucacagaaguacuuagagccgguuucuaucuagguuacuauaacgacggauuaaguuaucuaaaugauaggaacuuccaagauaaaugcauaccagcaaugaucgcaauacagaaaaauccaaauuucaaauugggaacagcaguccaagacgaagugauaacaucacuaggaaaacuaauaggcaacgcaagugcaaacgccgaaguaguaaacaacuguguuccaguacuaaaacaauucagagaaaaccuaaaccaauacgcaccugauuauguuaaagguacagccgucaacgaacucauaaaagguauagaguucgacuucucaggagcagcguacgaaaaagauguaaaaacaaugccaugguauggaaaaauugauccauuuauuaaugaauuaaaggcauuaggauuguacggaaacauaaccucggcuacagaaugggcaucagauguaggaauauacuaccuuucaaaauuuggucuauauagcacaaaccggaacgauauaguacaaucauuagaaaaagccguagacauguauaaauauggaaaaauagcauuugucgcaauggaaagaauaaccugggacuacgacggaauagggucuaacgggaagaaaguagaccaugauaaauuucucgaugaugccgaaaaacauuaucuaccuaaaacuuacacuuucgacaauggcacauucauaaucagagcuggcgacaaaguauccgaagagaaaauaaaaagauuauauugggcaucuagagagguaaaaagucaguuucacagagucguaggaaaugauaaagcucuugagguaggaaacgcagaugacguguuaacaaugaaaauauuuaauucaccggaagaauacaaguucaauacaaacauuaauggcguauccacagacaauggaggacuauauaucgaaccacgaggaacauucuauacauaugaaagaaccccacaacagaguauuuucagucuagaagaauuauuuaggcacgaauacacccauuauuuacaagcacguuaucuaguagacggacuauggggucagggacccuucuacgaaaagaaccgcuuaacaugguucgaugaagguacugcggaauuuuucgcuggaucaacacgaaccaguggaguacucccaagaaaaucaauuuuagguuaccuugcaaaagauaaagucgaucacagauacucacucaaaaagacacuaaauucaggauaugaugacucagacuggauguuuuauaauuauggauucgcagucgcacacuaccucuacgaaaaagauaugccaacguucauuaagaugaauaaggcaauacuaaauacagauguaaaaucauacgacgaaaucauaaagaaacuauccgacgacgcaaauaaaaauacagaauaccaaaaccauauacaagaacuagcagacaaauaucagggagcaggcaucccacuuguaagcgacgacuacuugaaagaccacggauacaagaaagcauccgaagucuacucagaaauauccaaagcagccucauuaacaaauacguccguaacugcugagaaaagucaauauuucaacacauucacacuacguggaacauacaccggcgaaacgaguaaaggagaguucaaagauugggacgaaaugucaaagaaauuagacgguacacuagaaucauuagccaaaaauucauggagcggauacaaaacucuuacggcauacuuuacaaacuauaggguuacaagugauaacaaaguacaauaugacguaguauuucauggaguccucacagacaaugcugauaucagcaacaacaaagcuccuaucgcuaaaguaacugggcccaguacgggagcaguaggcagaaacauugaguucucaggaaaagacucaaaagacgaagauggcaaaauaguauccuaugauugggacuuuggagauggagcaacaucaagaggcaaaaacucaguccacgcauacaagaaagcaggaacauauaauguaacacuuaaaguaacagacgauaaaggcgcaacagcaacagaaucauucacaauagaaauuaaaaacgaagauacaacaacaccaauaacaaaagaaauggaaccaaacgaugauauaaaagaggcaaacgguccaauaguggaaggaguaacaguaaaaggcgacuugaaugggagcgacgacgccgacacauuuuauuucgacguuaaagaggacggcgacguaacaauagaauuaccauacaguggaucaagcaacuuuacguggcuaguuuauaaagaaggagacgaccaaaaccauauagcaagugguauagacaaaaacaauaguaaaguagguacauuuaaaaguaccaaaggcagacauuacguauuuauauacaaacacgauucagcaucaaacauaucauauucucuaaauauaaaaggauuagggaaugaaaaacuuaaagaaaaagagaauaaugacagcagcgacaaagcaacugucauacccaacuuuaacacaacaaugcaagguucacuauuaggagacgacagucgagauuauuauagcuucgaaguaaaagaggaaggagaagucaauauagaauuagauaagaaagacgaauuuggaguaacauggacacuucauccugaaaguaauauaaacgauagaauaacauacggacaaguagacggaaacaaagucucaaauaaaguaaaacuuagaccagggaaauauuaucuacuuguauauaaauacaguggaucagguaacuaugaacuaagagucaauaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4922 - RNA, 3452 nt, Artificial Sequence
  mRNA product Design3 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaacuucuugaaaauaauccucaacagaggaaaaaccaugaaacgaaaaugucugucaaaaagauuaaugcuagcuauaacaauggccaccauauucacagucaacucaacacuaccaaucuaugcagcaguagauaaaaauaaugcuacagcugcaguacaaaacgaaucaaaacguuauacaguuucguacuuaaaaacauuaaauuauuaugaccucgucgaucuauugguaaaaacagaaaucgaaaauuuaccagauuuauuccaauacagcucagaugcuaaagaguucuaugguaacaaaacaagaaugagcuucauuauggacgaaauagguagaagggcuccacaauauacagaaauagaccauaaaggaauaccaacccuaguagaaguagucagagccggauuuuaucuuggauuccacaacaaagaauuaaaugaaaucaacaaaagaucauucaaagaacgaguaaucccaagcauauuagcaauacaaaagaauccaaauuucaaauuaggaacagaaguucaggacaaaauaguuagcgcaacaggacuucuagccggaaaugaaacagcaccuccugaaguaguaaauaacuuuacaccaauauugcaggauugcauaaagaacauagauagauacgcguuagaugaccuaaaaucuaaagccuuauucaaugugcuugcagccccaacauacgacaucacugaauaucuccgagccacaaaagaaaaaccagaaaacacaccaugguacgggaaaauagacggauucauaaacgaacucaagaaacuagcauuauaugguaaaauaaacgacaacaacucauggaucauagacaaugguauauaccauauagccccauuaggaaaacuucacagcaauaauaaaauaggaauagagacauuaacagaaguaaugaaaguauacccuuauuuaaguaugcaacauuuacaaucagcagaccaaaucaaaagacauuacgacaguaaagacgcggaaggaaacaaaauuccauuagacaaauuuaaaaaggaaggaaaagaaaaauauuguccaaaaaccuacacauuugacgauggaaaagucauuauaaaagccggagcacguguagaggaagaaaaagugaaaagacuuuacugggcauccaaagaaguaaauucacaauucuuucgaguuuacggaauugacaaaccccuggaagaaggaaacccagacgacauuuuaacgaugguaauauacaacaguccugaagaauacaaacuaaacaguguacuauauggcuacgauacgaacaacggaggaauguacaucgaaccagaaggaacauucuuuacguacgaaagagaagcacaggaaucaacuuauacacuagaggaacuauuucgacacgaauacacacacuaucuccaagguagauaugcaguuccgggacaauggggaagaacuaaguuauacgauaaugacagacuaacaugguaugaagaaggaggggccgaguuauucgcgggcaguaccagaacaagugggauauuacccagaaaaagcauuguauccaacauacacaacaccacgaggaauaaccgauauaaacuuucagauacaguccauucaaaauauggagcaucguuugaguucuacaauuaugcaugcauguuuauggauuauauguauaauaaagacaugggaauacucaacaaauuaaaugaccuagcaaagaacaaugacguggacggauacgacaacuacauaagagaccuaucaagcaacuacgcacuaaaugacaaauaucaagaccacaugcaagaaagaauagauaacuaugaaaaucucacaguaccuuucguugcagaugacuaccuaguccgucaugcauacaaaaauccgaacgaaauauauucagaaauuucagaaguugcuaaacuuaaagaugccaaaucagaaguaaagaaaagucaauacuucaguacuuuuacacuacgcggaagcuacacuggaggagcuucaaaaggaaaauuagaagaccaaaaagccaugaacaaauucauagacgauagccucaagaaauuagauacguauaguuggucuggauauaaaacacuaacagcguauuuuacaaauuauaaagucgauaguagcaacagaguaacauacgauguaguauuucauggauauuuaccaaaugaaggagauuccaaaaauucacucccguauggaaaaauaaacgguacauauaaagggacagaaaaagagaaaauaaaauucagcucagaaggaaguuuugacccggacgguaaaauaguaaguuacgaaugggacuucggugacggcaauaaaucaaacgaagaaaauccagaacacucuuaugauaaaguaggaaccuacacagugaaauuaaaaguaacagaugauaaaggugaaucauccgucaguacgacaacagcagaaauaaaagaucugucagaaaacaagcucccgguuauauauaugcauguaccaaaaagcggcgcccuaaaucaaaaaguagucuuuuacggaaaaggaacguaugacccagacggaaguauagcaggauaccaaugggauuuuggggaugguagugacuuuagcagcgaacaaaacccaucacaugucuacacuaagaaaggcgaguacacaguuacacucagaguaauggacucaaguggacaaaugucagagaaaacaaugaaaauaaaaauaacagauccaguauauccaauuggaacugaaaaagaaccaaacaauucuaaagaaacagccucaggucccauugucccuggcauaccuguaaguggaacaauagaaaacaccagugaccaagacuauuucuauuuugacguuauaacacccggcgaaguaaaaauagacaucaacaaacuuggauacggaggagcuacauggguuguauaugaugaaaacaauaaugcaguaaguuaugcaacugaugauggacaaaaccuaagcggaaaauuuaaagcagauaaacccggacgauauuauauacacuuauauauguucaacggaaguuauaugccauaucgaauaaauauagaaggaagcguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4923 - RNA, 3413 nt, Artificial Sequence
  mRNA product Design3 comprising derived and/or modified sequence from Clostridium histolyticum__BAA34542.1__ColH (opt13)
gggagagucccgcagucggcguccagcggcucugcuuguucgugugugugucguugcaggccuuauucaagcuuaccaugaaaagaaaauguuuaagcaaaagauuaaugcuagccauuacaauggcaacaauuuucacaguaaauaguacauuaccaauuuacgcagcugucgacaaaaacaacgcaacugcagcaguacagaacgaaucaaaacgguauacagugagcuaccucaaaacacuaaauuauuaugaccuaguagaucuacuuguaaaaacagaaauugaaaaucuaccagaccuauuccaauacuccucagaugcaaaggaauuuuauggaaacaaaacgcgcaugaguuucauuauggacgaaauaggaaggagggccccacaguacacagaaauagaucauaaaggcauaccaacgcuaguagaagucguaagagcaggauuuuaccuagguuuucacaacaaagaacucaacgaaauaaacaagcgcaguuuuaaagaaagagucauuccaucaauauuagcgauccagaaaaacccuaacuucaaacuaggaacagaaguacaagacaaaauuguaucagcgacaggacuacuagcaggaaaugagacagcaccaccagaaguaguaaauaauuucacaccaauauuacaagacugcaucaaaaauauagaccgauacgcauuggaugacuugaaaagcaaagcauuauuuaauguacuugcggcaccaacauaugacauaacagaauaccuaagagcuacaaaggaaaaaccagaaaacacaccaugguauggaaaaauagacggauuuauaaaugaacugaaaaaguuagcacuauacgguaaaaucaaugacaacaacagcuggauaauagacaaugggaucuaccauauagccccauuagguaaacuacauucaaacaacaaaauaggaaucgaaacccuaacagaaguaaugaaaguauauccauaccuaagcaugcaacacuugcaaagcgcagaccaaauaaaaaggcacuaugacagcaaagaugcagaaggaaacaaaauaccacucgacaaguucaagaaagaagguaaagaaaaauauugucccaaaacguauacguucgaugacggaaaaguaaucauaaaagcaggagccagaguagaagaagaaaaaguaaaaagacuuuauugggcuucgaaagaagucaacagccaauucuucagaguauaugguaucgacaaaccucuagaagaaggaaauccagaugacauucuaacaaugguaauauacaacucaccggaggaauacaaauuaaacaguguccuguacggauacgauacaaacaacgguggcauguauauagaaccagaagguacauucuucacuuaugaaagagaagcucaagaaagcaccuacacauuagaggaauuauuuagacaugaauauacucacuauuuacaaggccgauaugcaguaccaggccaaugggggcguacaaaauuauacgauaacgauagauuaacaugguaugaagaagguggagccgaacuauucgcagguuccaccaggacuucaggaauacuaccaaggaaaucaauuguaaguaauauacacaauaccacacguaacaacagauacaaauuauccgacacaguacacucaaaauacggagcaucauucgaguucuacaauuacgcauguauguuuauggauuauauguauaauaaagauaugggaauccuaaacaaacuaaaugacuuagcuaaaaauaaugacguugacggauacgacaauuacauaagggacuuaaguagcaacuacgcauuaaacgacaaauaccaagaccauaugcaagaaagaauagauaacuaugaaaaucuaacgguaccauuuguugcagacgauuauuuagucagacaugcauacaaaaacccuaaugaaauauacagugaaauaucagaaguggcaaaacuaaaagacgcuaaaucugaaguaaagaaaagccaauacuuuaguacauucacacuucgaggcucauacacaggaggagcaagcaaggguaaacucgaagaccaaaaagcaaugaacaaauuuauagaugauucacuaaagaaauuagacacauauaguuggagcggcuauaaaacacuaaccgcauacuuuacuaacuauaaaguagacucaucaaaccgcguaacauacgacguaguauuucacggauaccuccccaaugaaggugacagcaaaaacucacuacccuaugggaaaauaaaugggacauacaaagguaccgaaaaggagaaaauaaaauuuucuucugaaggcagcuucgacccagacggaaaaauagucuccuacgaaugggacuucggugauggaaacaaaagcaaugaagaaaauccagaacacaguuacgacaaaguagggacuuacacuguaaaacugaaaguuacagaugacaagggcgaaagcucuguaaguacaaccacugccgaaauaaaagaccuaucagaaaacaaacuuccaguaauauauaugcacguuccuaaaucuggagcuuugaaccaaaaaguaguuuucuacggaaaaggcacguaugacccggauggaucaaucgcaggcuaucaaugggacuuuggcgauggaagugacuuuuccagcgaacaaaacccuagccacgucuauacuaagaaaggagaauauaccgugacauuacgaguaauggauucaucaggacaaaugucagagaaaaccaugaaaauaaaaaucacugacccaguauauccaauaggaacagaaaaagaaccaaacaacaguaaagaaacagccucagguccaauaguaccuggaauaccagucucaggcacaauagaaaacacaucagaccaagacuacuucuauuuugauguuauaacaccaggugaagucaaaauagauauaaauaaauuaggauaugguggugcaacaugggucguauacgaugaaaacaauaacgccguuaguuacgcaacagacgauggucaaaaccuaucugggaaauucaaagcagauaaaccuggaagauacuauauacaucuauauauguuuaacggcagcuacaugccauauagaauaaauauagaagggucaguaggaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4924 - RNA, 3347 nt, Artificial Sequence
  mRNA product Design3 comprising derived and/or modified sequence from Clostridium histolyticum__BAA34542.1__HsALB(1-18)_ColH(41-1021) (opt13)
gggagagucccgcagucggcguccagcggcucugcuuguucgugugugugucguugcaggccuuauucaagcuuaccaugaaauggguaacuuuuauaucauuauuauuccuauucaguucagcauauaguguacaaaaugaaucaaaaagguacacaguauccuaucuaaaaacguuaaauuauuacgauuuaguagaucuccuagucaaaacugaaauagaaaacuuaccagaccuauuccaauauucguccgaugcaaaagaauuuuauggaaauaaaacccgaaugucauucaucauggacgaaauuggacgaagggcaccgcaauacacagaaauagaucacaaagguauuccaacccucguagaagucguaagagcuggcuucuaccuaggauuucauaauaaagaauuaaaugaaauaaacaaaaggucauucaaagaaagaguaauacccuccauauuagcaauacaaaaaaauccuaacuuuaaacuuggaacagaaguucaagacaaaaucguuucagcgaccgguuuacuggcaggcaacgaaacagcaccucccgaagucguaaacaacuucacaccaauuuuacaagauuguauaaaaaauauugaucgauacgcuuuagacgaccuuaaaagcaaagcgcuauucaacguacucgcagcaccuacauacgauaucaccgaauaccuucgagcuacaaaagaaaaaccagaaaauacuccuugguauggcaaaauagacggauucauaaacgaauuaaaaaaauuagcuuuauauggaaaaauuaaugauaauaacucauggauaauagacaauggaauauaucacauugcaccauuaggaaaauuacauucuaauaauaaaauaggaauagaaacauugacagaaguaaugaaaguguaccccuaccuaagcaugcaacauuuacagucagcugaucaaauuaaacgacacuacgauucaaaagacgcagaaggcaauaaaaucccacuugacaaauucaaaaaagaaggaaaagaaaaauacuguccaaaaacauauacauuugacgacggaaaaguaauaauaaaagcuggugcaagaguagaagaagaaaaagucaaaagacuauauugggcaagcaaagaaguaaauucacaauucuuucgaguauauggaauugacaaaccccuagaagagggaaacccagacgauauacuaacaauggugauauacaacucaccagaagaauauaaacuaaacaguguacuauacggauacgauacaaacaauggcgggauguacauagaaccagaagguacauucuucacguaugaaagggaagcacaagaauccaccuacacacucgaagaacuauucagacaugaauacacucauuaucuacaaggcagauaugccguaccgggacaauggggaagaacaaaauuauaugacaacgacagauuaacaugguaugaagaaggaggagcagaacuauuugcuggcaguaccagaacaagugggauccuucccagaaaaucaauugugaguaacauacacaacacaacgagaaauaauagauauaaacuaagcgauaccguacauaguaaauauggagccucguucgaauuuuauaauuaugccuguauguucauggauuacauguauaacaaagauauggguauauuaaauaaauuaaacgaccucgcuaaaaauaaugauguagacggauacgacaacuacauaagagauuuauccagcaacuaugcauuaaaugacaaauaucaagaccacaugcaagaaagaaucgacaacuaugaaaaucuuacuguaccauucguagcagacgauuaccuaguuagacacgccuauaaaaaucccaacgaaauauauagcgaaauaucugaaguagcaaagcuaaaagacgcaaaaagcgaagugaaaaaaucacaauacuuuucaacuuucacauugagaggcucauacacaggaggugcaagcaaaggaaaauuagaagaucaaaaagcaaugaauaaauuuauagacgacagucuaaaaaaauuagauacauacucauggucagguuacaaaacacuaacggcauacuucacaaacuauaaaguagauuccucaaauagaguaacauacgaugucguuuuucauggauaucuaccuaacgaaggagacagcaagaauagucuaccauauggaaaaauaaauggaacguacaaaggaacugaaaaagaaaaaaucaaauucucaucagaaggcaguuucgaucccgacgggaaaauaguaucauacgaaugggauuuuggagauggcaacaaaucaaacgaagaaaacccagaacauucauaugauaaagucggaaccuacacaguaaaacuaaaaguaaccgaugacaagggagaaucaucgguuuccaccacgacagcugaaauaaaagacuuaucagaaaacaaauuacccguaauauacaugcacguaccaaaaucaggcgcgcuuaaccaaaaagugguuuucuauggaaaaggcacauacgauccagauggaagcaucgcaggauaccagugggauuucggagaugguucagauuuuaguucugaacaaaauccuagccauguauacaccaaaaaaggugaauacacaguuacacuuaggguuauggacuccucaggacaaaugagcgaaaaaacaaugaaaauaaaaauaaccgacccaguauacccaauaggaaccgaaaaggaaccaaacaauucuaaagaaacagcaucagguccaauaguaccaggaaucccagugucagggacaauagaaaacacaucagaccaagacuauuucuauuucgacguaauaacacccggagaaguaaaaauagacauaaacaaauuaggauacgguggcgccacuuggguuguauaugacgaaaacaacaacgcaguaucuuaugcaacugacgacggccaaaacuuaaguggaaaguuuaaagccgauaaaccuggacgauacuacauacaccuauacauguucaacggcaguuacaugccauacagaauaaacauagaagguagcguuggucgauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4925 - RNA, 3485 nt, Artificial Sequence
  mRNA product Design3 comprising derived and/or modified sequence from Clostridium histolyticum__BAA34542.1__HsALB(1-18)_ColH(1-40)_CS-F_ColH(41-102 1) (opt13)
gggagagucccgcagucggcguccagcggcucugcuuguucgugugugugucguugcaggccuuauucaagcuuaccaugaaauggguaacauucaucagcuuacuauuuuuauuuucaucugccuauuccaugaaaagaaaaugucuaucaaaaagauuaauguuagcaauaacaauggcuacaauauucacggucaacaguacacucccaauauacgcugcagucgacaaaaacaacgcgacugcagcacgcaggcgcagaaaaagaguacagaaugaaucaaaacgauacaccgugucguaccuaaaaacccuaaauuacuacgaccucguugaccuauuaguaaaaacagaaauagaaaauuuaccagaccuuuuucaauacucaagcgaugccaaggaauuuuacggaaauaaaacaaggaugaguuucauaauggaugagaucggccgccgagcaccacaauauaccgaaauagaucauaaaggaaucccgacguugguugaaguuguuagagcaggauucuauuuggguuuucacaacaaagaacuaaaugaaauaaauaaacgcagcuucaaagaaagaguaauaccaagcaucuuagcgauucagaaaaauccuaauuucaaacuaggaacggaaguacaagacaaaaucgucucagcaacgggauuguuagcgggaaacgaaaccgcuccaccagaagucguaaacaacuuuacccccauacuacaagacugcaucaaaaauauagauagauacgcauuagaugauuuaaaaucuaaagcauuauucaacguauuggcggcaccaacauaugauauaacagaauauuuaagagcgacaaaagaaaaaccagaaaacacuccaugguauggcaaaauugacggauuuauaaaugaauuaaagaaauuggcccuauacggaaaaauaaaugacaauaacagcuggaucauugacaacggaauauaccacauagcucccuuaggaaaacuacauaguaacaauaaaaucgguauagaaacauuaacugaaguaaugaaaguuuacccauaucuaaguaugcaacauuuacaaucagcagaucaaauaaaaaggcacuaugauagcaaagacgcagagggaaacaaaauaccacuagacaaauuuaagaaagagggaaaagaaaaauacuguccaaaaaccuacacauucgaugacggaaaaguaaucauaaaagcaggagcaagaguagaagaggaaaaaguaaaacgauuauauugggcaucuaaagaaguuaauucucaauucuucagaguauacggaauagacaaaccacuagaagaaggcaauccagacgacauauuaacaaugguaauuuacaacaguccugaagaauauaaauuaaauucaguauuauauggauacgacacaaacaauggaggaauguacaucgaacccgaaggcacauucuuuaccuacgaaagagaggcucaagaaucuacuuauacucucgaagaacuuuuuaggcaugaauauacacacuaucuccaagguagauaugccguaccaggacaaugggguagaacaaaacuauacgauaaugacagacuuacuugguaugaagaaggaggcgcagaacuauuugcgggcagcacacguacuucaggcauccuaccacgaaaauccauaguuuccaacauccacaauacaacaagaaacaaccgauauaaauuaucagauacuguccacucaaaauacggugcguccuucgaauuuuacaacuacgcauguauguuuauggacuacauguauaauaaagauauggguauacuuaacaaauugaaugacuuagccaaaaauaaugauguagacggauacgauaacuacauaagagaccuaucaucaaacuaugcauuaaaugacaaauaucaagaccauaugcaagaaagaauugauaacuacgaaaacuuaacuguaccauucguagcagaugauuacuuaguaagacaugcauauaaaaauccaaacgaaaucuacagcgaaaucagcgaaguagccaaacucaaagaugccaaauccgaagugaagaaaucacaauacuucucaacauucacuuuaagagguaguuacacaggaggugcauccaaaggaaaauuagaagaccaaaaagccaugaauaaauuuauagacgacagucuaaagaaauuagauaccuacucauggaguggauacaaaacauuaacagccuacuucacaaacuacaaaguagauucaucuaaccgagucaccuacgacguaguauuucauggcuacuuaccaaacgaaggcgauagcaaaaacucacuaccguacggcaaaauuaacggcacauacaaaggaacagaaaaagagaaaaucaaauucuccuccgaagguagcuucgacccagacgguaaaaucguaaguuaugaaugggauuucggugacggcaacaaaucgaacgaagaaaacccagaacacagcuaugauaaaguagguacauauacagucaaacuaaaaguaaccgaugauaaaggugaaucgucugucucaacgaccacagccgaaauaaaagauuuguccgaaaauaaauuaccagucaucuauaugcaugucccaaaaucaggagcccuaaaccaaaaagugguuuucuauggaaaaggaacauacgacccugauggaucaauagcaggcuaucaaugggauuucggugacggcucagacuuuagcagugaacaaaauccaucgcauguguacacaaagaaaggagaauacacaguaacacuacgagucauggauucuuccggacaaaugagugagaaaacgaugaaaauuaaaauaacagacccaguauacccaauaggaacagaaaaagaaccaaauaacuccaaagaaaccgcaucuggaccaauaguccccggaauaccaguaagcggcacuaucgaaaauacaucagaccaagacuauuuuuacuuugacguaauaaccccaggagaaguaaaaauagacauaaauaaauuaggauacggcggcgcuacauggguaguuuacgacgaaaacaacaaugcaguaucauacgcaacagaugacggacaaaacuuaaguggaaaauuuaaagcugacaaaccaggaagauauuacauacauuuauauauguucaauggauccuauaugccauacagaaucaacauagaaggaagcguaggaagguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4926 - RNA, 923 nt, Artificial Sequence
  mRNA product Design3 comprising derived and/or modified sequence from Homo sapiens__NP_001133.1__HsAMELX (opt13)
gggagagucccgcagucggcguccagcggcucugcuuguucgugugugugucguugcaggccuuauucaagcuuaccaugggaacauggauauuauucgcaugccuacuaggagcagcauucgcaaugccacuaccaccacacccaggacacccaggauacauaaacuucucauacgaaguacuaacaccacuaaaaugguaccaaucaauacgacccccauacccaucauacggauaugaacccaugggaggauggcuacaccaccaaauaauaccaguacuaucacaacaacaucccccaacacacacauuacaaccucaccaccacauaccaguaguaccagcacaacaaccaguaauaccacaacaaccaaugaugccaguaccaggacaacacucaaugacaccaauacaacaccaccaaccaaaccuaccaccaccagcccaacaaccauaccaaccacaaccaguacaaccacaaccacaccaaccaaugcaaccacaaccaccaguacacccaaugcaaccacuaccaccacaaccaccacuaccaccaauguucccaaugcaaccacuaccaccaaugcuaccagaccuaacacucgaagcauggccaucaaccgauaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4927 - RNA, 482 nt, Artificial Sequence; identical to SEQ ID NO: 4375
  mRNA product Design3 comprising derived and/or modified sequence from Homo sapiens__NP_001133.1__HsAMELX-TRAP (opt13)

SEQ ID NO: 4928 - RNA, 515 nt, Artificial Sequence; identical to SEQ ID NO: 4376
  mRNA product Design3 comprising derived and/or modified sequence from Homo sapiens__NP_001133.1__HsAMELX-LRAP (opt13)

SEQ ID NO: 4929 - RNA, 554 nt, Artificial Sequence; identical to SEQ ID NO: 4377
  mRNA product Design3 comprising derived and/or modified sequence from Homo sapiens__NP_001133.1__HLA-A2-SP_HsAMELX(17-60) (opt13)

SEQ ID NO: 4930 - RNA, 587 nt, Artificial Sequence; identical to SEQ ID NO: 4838
  mRNA product Design3 comprising derived and/or modified sequence from Homo sapiens__NP_001133.1__HLA-A2-SP_HsAMELX(17-47,168-191) (opt13)

SEQ ID NO: 4931 - RNA, 926 nt, Artificial Sequence
  mRNA product Design3 comprising derived and/or modified sequence from Homo sapiens__NP_001134.1__HsAMELY (opt13)
gggagagucccgcagucggcguccagcggcucugcuuguucgugugugugucguugcaggccuuauucaagcuuaccaugggaacauggauacuauucgcaugccuaguaggagccgcauucgcaaugccacuaccaccacauccaggacacccaggauauauaaacuucucauacgaaguauuaacaccacucaaaugguaccaauccaugauaagacccccauacucaucauacggauacgaaccaaugggcggauggcuacaccaccaaauaaucccaguaguaucccaacaacacccacuaacacacacauuacaaucacaccaccacauaccaguaguaccagcacaacaaccaagaguaagacaacaagcauuaaugccaguaccaggacaacaaucaaugacaccaacacaacaccaccaaccaaaccuaccacuaccagcacaacaacccuuccaaccucaaccaguacaaccacaaccacaccaaccaaugcaaccacaaccaccaguacaaccaaugcaaccacuauuaccacaaccaccacuaccacccauguucccacuaagaccauuaccaccaauacuaccagaccuacaccuagaagccuggccagcaacagacaaaacaaaacaagaagaagucgacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4932 - RNA, 485 nt, Artificial Sequence; identical to SEQ ID NO: 4380
  mRNA product Design3 comprising derived and/or modified sequence from Homo sapiens__NP_001134.1__HsAMELY-TRAP (opt13)

SEQ ID NO: 4933 - RNA, 518 nt, Artificial Sequence; identical to SEQ ID NO: 4841
  mRNA product Design3 comprising derived and/or modified sequence from Homo sapiens__NP_001134.1__HsAMELY-LRAP (opt13)

SEQ ID NO: 4934 - RNA, 557 nt, Artificial Sequence
  mRNA product Design3 comprising derived and/or modified sequence from Homo sapiens__NP_001134.1__HLA-A2-SP_HsAMELY(17-61) (opt13)
gggagagucccgcagucggcguccagcggcucugcuuguucgugugugugucguugcaggccuuauucaagcuuaccauggcaguaauggcaccaagaacacuaguacuacuacuaucaggagcacuagcacuaacacaaacaugggcaaugccacuaccaccacacccaggacacccaggauauauaaauuucucauacgaaguacuaacaccacuaaaaugguaucaaucaaugauaagaccaccauacucaucauacggauacgaaccaaugggaggaugguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4935 - RNA, 590 nt, Artificial Sequence
  mRNA product Design3 comprising derived and/or modified sequence from Homo sapiens__NP_001134.1__HLA-A2-SP_HsAMELY(17-48,169-192) (opt13)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaucaaucaaugauaagaccaccaccaauacuaccagaccuacaccuagaagcauggccagcaacagacaaaacaaaacaagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4936 - RNA, 917 nt, Artificial Sequence
  mRNA product Design3 comprising derived and/or modified sequence from Sus scrofa__NP_999071.1__SsAMELX-001-1 (opt13)
gggagagucccgcagucggcguccagcggcucugcuuguucgugugugugucguugcaggccuuauucaagcuuaccaugggaacauggauacuauucgcaugccuacuaggagcagcauucucaaugccacuaccaccacacccaggacauccaggauacauaaacuucucauacgaaguacucacaccauuaaaaugguaccaaaacaugauaagacacccauacacaucauacggauacgaaccaaugggcggauggcuacaccaccaaauaauaccaguaguaucacaacaaaccccacaaucacacgcauuacaaccacaccaccauauaccaaugguaccagcacaacaaccaggaauaccacaacaaccaaugaugccacuaccaggacaacacucaaugacaccaacccaacaccaccaaccaaaccuaccccuacccgcacaacaaccauuccaaccacaaccaguacaaccccaaccacaccaacccuuacaaccacaaucaccaaugcacccaauacaaccacuacucccacaaccaccacuaccaccaauguucucaaugcaaucacuacuaccagaccuaccauuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4937 - RNA, 485 nt, Artificial Sequence; identical to SEQ ID NO: 4385
  mRNA product Design3 comprising derived and/or modified sequence from Sus scrofa__NP_999071.1__SsAMELX-TRAP (opt13)

SEQ ID NO: 4938 - RNA, 518 nt, Artificial Sequence
  mRNA product Design3 comprising derived and/or modified sequence from Sus scrofa__NP_999071.1__SsAMELX-LRAP (opt13)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaacaugauaagacacccaucacuacuaccagaccuaccauuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4939 - RNA, 557 nt, Artificial Sequence; identical to SEQ ID NO: 4387
  mRNA product Design3 comprising derived and/or modified sequence from Sus scrofa__NP_999071.1__HLA-A2-SP_SsAMEL(17-61) (opt13)

SEQ ID NO: 4940 - RNA, 590 nt, Artificial Sequence
  mRNA product Design3 comprising derived and/or modified sequence from Sus scrofa__NP_999071.1__HLA-A2-SP_SsAMEL(17-49,167-189) (opt13)
gggagagucccgcagucggcguccagcggcucugcuuguucgugugugugucguugcaggccuuauucaagcuuaccauggcaguaauggcaccaagaacauuaguacuacuacuaucaggagcacuagcacuaacacaaacaugggcaaugccacuaccaccacacccaggacacccaggauacauaaacuucucauacgaaguacuaacaccacuaaaaugguaccaaaacaugauaagacacccaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4941 - RNA, 881 nt, Artificial Sequence
  mRNA product Design3 comprising derived and/or modified sequence from Sus scrofa__P45561-2__SsAMELX-001-2 (opt13)
gggagagucccgcagucggcguccagcggcucugcuuguucgugugugugucguugcaggccuuauucaagcuuaccaugggaacauggauacuauucgcaugccuauuaggagcagcauucucaaugccacuaccaccacacccaggacacccaggauauauaaacuucucauacauaagacacccauacacaucauacggauacgaaccaaugggaggauggcuacaccaccaaauaauuccaguaguaucacaacaaacaccacaaucacacgcacuacaaccacaccaccacauaccaaugguaccagcacaacaaccaggaauaccacaacaaccaaugaugccacuacccggacaacacucaaugacacccacacaacaccaccaaccaaaccuaccacuaccagcacaacaaccauuccaaccacaaccaguacaaccacaaccacaccaaccauuacaaccacaaucaccaaugcacccaauacaaccacuacuaccacaaccaccacuaccacccauguucucaaugcaaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4942 - RNA, 917 nt, Artificial Sequence
  mRNA product Design3 comprising derived and/or modified sequence from Sus scrofa__NP_998965.1__SsAMELX-001-3 (opt13)
gggagagucccgcagucggcguccagcggcucugcuuguucgugugugugucguugcaggccuuauucaagcuuaccaugggaacauggauauucuucgcaugccuauuaggagcaucccuagcaaugccacuaccaccacacccaggacacccaggauacauaaacuucucauacgaaguacucacaccauuaaaaugguaccaaaacaugauaagacacccauacacaucauacggauacgaaccaaugggaggcuggcuacaccaccaaauaauaccaguaguaucacaacaaacaccacaaucacacgcacuacaaccacaucaccacauaccaaugguaccagcccaacaaccaggaauaccacaacaaccaaugaugccacuaccaggacaacacucaaugacaccaacacaacaccaccaaccaaaccuaccacuaccagcacaacaaccauuccaaccacaaccaguacaaccacaaccccaccaaccacuacaaccacaaucaccaaugcacccaauccaaccacuacuaccacaaccaccacuaccaccaauguucucaaugcaaucccuacuacccgaccuaccacuagaagccuggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4943 - RNA, 566 nt, Artificial Sequence; identical to SEQ ID NO: 4391
  mRNA product Design3 comprising derived and/or modified sequence from Sus scrofa__K7GPB2__SsAMELX-002 (opt13)

SEQ ID NO: 4944 - RNA, 959 nt, Artificial Sequence
  mRNA product Design3 comprising derived and/or modified sequence from Sus scrofa__K7GLD0__SsAMELX-003 (opt13)
gggagagucccgcagucggcguccagcggcucugcuuguucgugugugugucguugcaggccuuauucaagcuuaccaugggaacauggauacuauucgcaugccuauuaggagcagcauucucaaugccacuaccaccacacccaggacacccaggauacauaaacuucucauacgaagaccuauacuuagaagcaauaagaauagacagaacagcauucguacuaacaccacuaaaaugguaccaaaacaugauaagacacccauacacaucauacggcuacgaaccaaugggaggauggcuacaccaccaaauaauaccagucguaucccaacaaacaccccaaucacacgcauuacaaccacaccaccacauaccaauggucccagcacaacaaccagguauaccccaacaaccaaugaugccacuaccaggacaacacucaaugacaccaacacaacaccaccaaccaaaccuaccacuaccagcacaacaaccauuccaaccacaaccaguacaaccacaaccacaccaaccacuacaaccacaaucaccaaugcacccaauacaaccacuacuaccacaaccaccauuaccacccauguucucaaugcaaucacuauuacccgaccuuccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4945 - RNA, 845 nt, Artificial Sequence
  mRNA product Design3 comprising derived and/or modified sequence from Sus scrofa__K7GPE9__SsAMELX-004 (opt13)
gggagagucccgcagucggcguccagcggcucugcuuguucgugugugugucguugcaggccuuauucaagcuuaccaugggaacauggauacucuucgcaugccuacuaggcgcagcauucuccaugccacuaccaccacacccaggacaccccggauacauaaacuucucauacgaaguacucacaccacuaaaaugguaccaaaacaugauaagacacccaacaccacaaucacacgcacuacaaccacaccaccacauaccaaugguaccugcacaacaaccaggaauaccacaacaaccaaugaugccacuaccaggccaacacuccaugacacccacacaacaccaccaaccaaaccuaccacuaccagcccaacaaccauuccaaccacaacccguacaaccacaaccacaccaaccauuacaaccccaaucaccaaugcacccaauacaaccacuacucccacaaccaccacuaccaccaauguucucaaugcaaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4946 - RNA, 869 nt, Artificial Sequence
  mRNA product Design3 comprising derived and/or modified sequence from Sus scrofa__J9JIM4__SsAMELX-201 (opt13)
gggagagucccgcagucggcguccagcggcucugcuuguucgugugugugucguugcaggccuuauucaagcuuaccaugccacuaccaccacacccaggacacccaggauacauaaacuucucauacgaaguacuaacaccacuaaaaugguaccaaaacaugauaagacaccccuacacaucauacggauacgaaccaaugggaggauggcuacaccaccaaauaauaccaguaguaucacaacaaacaccacaaucacacgcacuacaaccacaccaccacauaccaaugguaccagcccaacaaccaggcauaccacaacaaccaaugaugccacuaccaggacaacacucaaugacaccaacacaacaccaccaaccaaaccuaccacuaccagcacaacaaccauuccaaccacaaccaguacaaccacaaccacaccaaccacuccaaccacaaucacccaugcaccccauacaaccauuacuaccacaaccaccacucccaccaauguucuccaugcaaucacuacuaccagaccuaccacuagaagcauggccagcaacagacaaaacaaaaagagaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4947 - RNA, 3308 nt, Artificial Sequence
  mRNA product Design3 comprising derived and/or modified sequence from Homo sapiens__NP_006120.1__HsBMP1 (opt13)
gggagagucccgcagucggcguccagcggcucugcuuguucgugugugugucguugcaggccuuauucaagcuuaccaugccagguguagcacgucuaccauuauugcuagguuuauugcuacuaccccgaccgggacgaccacuagacuuagccgauuacacauaugaccuagcagaagaggacgauagugaaccauuaaacuacaaagauccauguaaagcugccgcauucuuaggugauauagcuuuagacgaagaagauuuacgugcauuucaaguccagcaagcaguagauuuacguagacauacugcacgcaaaaguucaauaaaagcagcuguaccaggaaacacaucaacaccuuccugucaaucaacaaauggucaaccucaaagaggggcuugcggacguuggagggggagaaguagaaguagacgugcagcaacaagucgaccagaacgaguauggccagauggaguaauuccauuuguaauugguggaaacuuuacuggaucacaaagagcuguauucaggcaagcuaugagacauugggaaaaacauacuugcguuacauucuuagaacgaacagaugaagauuccuauauaguauuuacuuauagaccuugugggugcuguaguuauguggguagaagaggggguggaccacaagcaauaucaauugguaaaaauugugacaaauuuggaauaguuguacaugaacuaggacauguaguaggauuuuggcacgaacauacaagaccagauagagacagacauguauccauaguuagagaaaauauacaaccaggacaagaauauaauuuccuaaaaauggagccacaggaaguagagaguuugggagaaacuuacgacuucgacaguauaaugcauuaugcaagaaauacuuuuucacgaggaauauuccuagauacuauugugccuaaauacgaagugaaugguguaaaaccuccaauuggucaaaggacuagguuaagcaaaggagauauagcacaagcgcgcaaacuuuauaaauguccagcauguggugaaacauuacaggacucaacaggaaauuuuucaucaccugaauacccuaacggguauagugcacauaugcacuguguauggagaauaucaguaacaccaggagagaaaauaauauuaaacuucacuagccuggaucuuuauagaucgagacucuguugguaugauuauguagaaguuagagauggcuucuggagaaaagcaccauugagagggcguuuuuguggcaguaaacuaccagaaccaauaguaucuacagauuccagauuaugggucgaguucagaaguucauccaauuggguaggaaaagguuucuucgccguauaugaagcgauaugcggaggggauguaaagaaagacuauggucauauacaaagcccuaauuauccugaugacuauaggccaaguaaaguuuguauuuggagaauacaagugucagaagguuuucacguuggacucacauuucaaucuuuugaaauagagcgccaugacucaugugcguaugacuauuuagagguaagagacggacauucagaaucuucuacucuuauaggaagauauuguggauaugagaaaccagaugauauaaaaaguacaaguucucgacuaugguuaaaauuuguaagcgauggaagcauaaauaaagcaggauuugcaguaaauuucuuuaaagaaguugaugaaugcucgagaccuaauagagggggaugcgaacaacgaugucuaaauacacucggaagcuacaaauguagcugugauccaggauaugaacuugcaccggacaaaagaagaugugaagcugcaugcggcggauuucuaaccaaacucaauggaucaauuacuuccccaggauggccuaaagaauauccaccgaauaaaaacugcauauggcaauuaguagcuccaacacaauaucgcaucagcuuacaauuugacuucuuugaaacugagggaaaugauguuuguaaauaugacuuugucgaagucagaucaggccucacagcagauucuaaauuacacggcaaauuuuguggaagcgaaaaaccggaaguaauaacaucacaauacaauaacaugagaguagaguuuaaaagcgauaauacaguaaguaagaaaggauuuaaagcacacuucuucucagauaaagacgaauguucaaaagacaaugggggaugucaacaagacuguguaaauacguuuggaucauaugaaugucaaugccgaaguggauucguacuucaugauaauaaacaugauuguaaagaagcagguugcgaucacaaaguuacaucaacuucaggcacaauaacuucaccuaacuggccagauaaauauccaucaaagaaagaauguacaugggcaauaucuucaaccccaggucaucgcguaaaauuaacauuuauggaaauggauauugaaucacaaccagaaugugcauaugaucacuuagaaguauucgacggaagggaugcaaaagcaccaguauuagguagauuuuguggcaguaagaaaccagaaccaguucuugcgacaggaagccguauguuuuuaagauuuuacucagauaauuccguacaaagaaaaggauuucaagccucccaugcgacggaauguggaggacaaguacgagcagauguuaaaaccaaagaccuauacucacacgcacaauuuggugauaauaauuacccaggugggguagacugcgaauggguaauaguagcagaagaaggguacggaguugaauuaguauuccaaacauuugaaguagaagaagaaaccgauuguggcuaugauuauauggaacuauucgacggauacgacuccacagcaccgagauuaggacgauacuguggaaguggaccaccagaagaaguuuauucagcaggagacucagucuuagugaaauuucauucggacgacacaauaaccaagaaaggauuccacuuaagauacacuucaacuaaauuccaagauacacuacacaguagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4948 - RNA, 1538 nt, Artificial Sequence
  mRNA product Design3 comprising derived and/or modified sequence from Homo sapiens__NP_001191.1__HsBMP2 (opt13)
gggagagucccgcagucggcguccagcggcucugcuuguucgugugugugucguugcaggccuuauucaagcuuaccauggucgccggaaccagaugccuauuagcccuacuauuaccacaaguucuacuagguggagcugcaggauuaguaccagaacuaggaagacgaaaauucgcggcagcauccucaggaagaccaucaucacagccaucagacgaaguacuauccgaauucgaacuaagguuauuaucuauguuuggauuaaaacaaagaccaacgccaucuagagacgcagucguuccaccauacaugcuagaucuauauagaagacacuccggacaaccaggauccccagcacccgaucauagauuagaacgagccgcaucacgugcaaacaccguaagauccuuccaccacgaagaaucucuagaagaacuaccagaaacaucaggaaaaacuacaagaagauucuucuuuaaccuaucaucuaucccaacagaagaauucaucacaucagcagaauuacaagucuuuagagaacaaaugcaagacgcauuaggaaauaacucaucauuucaccacagaauuaacauauacgaaauaaucaaaccagcaaccgcaaacagcaaauucccagucacucgauuacuagauacaagacuaguuaaccaaaacgcaucaagaugggaaucauuugacguaacucccgcaguuaugagauggacagcacaaggacacgcaaaucacggauuugucguugaaguagcccauuuagaagaaaaacaaggaguuucaaaaagacacguccgcauaagcagaucacuacaucaagacgaacauucuuggagucaaauaagaccacuacuuguaacauucggccacgacggaaaaggacacccauuacacaaaagagaaaaaagacaagcaaaacacaaacaaagaaaaagacuaaaaucaucaugcaaaagacauccauuauacguagauuucucagauguaggauggaacgacuggauaguagcaccaccaggauaccacgcauuuuacugccauggagaaugcccauuuccacuagcagaccaccucaacucaaccaaccacgcaauaguucaaacccuaguaaauucaguaaauucaaaaauaccaaaagcaugcugugucccaacagaacuuucugcaauaucaaugcuauauuuagaugaaaacgaaaaaguaguucuaaaaaauuaccaagacauggucguagaaggaugcggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4949 - RNA, 1574 nt, Artificial Sequence
  mRNA product Design3 comprising derived and/or modified sequence from Homo sapiens__NP_001193.2__HsBMP4 (opt13)
gggagagucccgcagucggcguccagcggcucugcuuguucgugugugugucguugcaggccuuauucaagcuuaccaugauaccaggaaauagaaugcucaugguaguauuauuaugccaaguacuucuagguggagcuucacaugcaucacuuauaccagaaaccggaaaaaaaaaaguagcagaaauacaaggacaugccggaggaagaagauccggacaaucacaugaauuacuacgagauuuugaggccacuuuauuacagauguucggauuaagaagacgaccucaaccaucaaaaucagcaguaauuccagacuacaugcgagaucuauacagauuacaaucaggagaagaagaagaagaacaaauacacaguaccggacuagaauacccagaaagaccagcaucaagagccaauaccguuagaucauuccaccaugaagaacauuuagaaaauauaccaggaacaucagaaaauucagcuuucagauuuuuauucaauuuaagcagcauaccagaaaacgaagucauaucaucagcagaacuaagacuauuuagagaacaaguugaccaaggaccugacugggaacgcggauuccacagaauaaauauauacgaaguaaugaaaccaccugcugaaguaguaccaggacaccuaauaacuagauuacuagauacaagacuaguacaccauaauguaacaaggugggaaacauuugacguaucaccggcaguauuacgguggacaagagaaaaacaaccaaauuacggacuagcaauagaagucacacacuuacaucaaacaagaacacaucagggucaacacguaagaauaucacgaucacuuccacaagguucagguaacugggcccaauuaagaccauuacuaguaacauuuggacaugacggaagaggacacgccuuaacacgaaggcgaagagccaaaagaaguccaaaacaccauucacaaagagcacgaaaaaaaaacaaaaauugccgaagacauucacuauacguagacuuuucagaugucggauggaaugacuggaucguagcaccaccaggcuaccaagcauuuuacugucacggagauugcccauuuccacuagcagaucacuuaaacucaaccaaucacgcaauaguacaaacacuaguaaauucuguaaacagcucuauaccaaaagcuuguuguguaccaacagaacuaucagccauaucuauguuauaucuagaugaauaugauaaaguaguauuaaaaaacuaucaagaaauggucguagaaggaugcggauguagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4950 - RNA, 1889 nt, Artificial Sequence
  mRNA product Design3 comprising derived and/or modified sequence from Homo sapiens__NP_001709.1__HsBMP6 (opt13)
gggagagucccgcagucggcguccagcggcucugcuuguucgugugugugucguugcaggccuuauucaagcuuaccaugcccggauuaggaagacgagcacaauggcuaugcugguggugggguuuauuauguagcuguugcgguccaccaccuuuaagaccaccauuaccagccgcagcugcugcugcagcaggcggucaacuauuaggagaugggggaucacccgggagaacagaacaacccccaccaucaccccaaagcucaucaggguucuuauacagaagauuaaaaacacaagaaaaacgcgaaaugcaaaaagaaauacuaaguguauuaggauugccacauagaccuagaccauuacauggauuacaacaaccacaaccuccagcuuuaagacaacaagaagaacaacaacaacaacaacaauuacccagaggagaaccacccccaggaagacuaaaaucugcuccauuauucaugcuagaccuauacaaugcacuaagcgcagacaaugacgaagauggagcuucugaaggagaaagacaacaaucauggccucaugaagcagcuucaagcagucaaaggagacaaccaccaccaggagcagcacacccacuuaaucgaaaaagccuacuagcacccggcucuggaucaggaggcgcaaguccauuaacaucagcacaagauagcgcguuuuuaaaugacgcagacaugguaaugucauucgugaauuuaguagaauacgauaaagaauuuucuccaagacaaagacaccacaaagaguucaaauucaaucuaucccaaauaccugaaggagaaguaguaacugcagcagaauuuagaaucuacaaagacuguguaaugggaucauucaaaaaucaaacuuucuuaauaucuaucuaccaaguauuacaagaacaucaacauagagacucugauuuauuccucuuagacacaagaguuguaugggcaucagaagaagguuggcuagaauuugacauuacugcaacaucaaacuuauggguaguaacaccacaacauaacaugggacuacaauuaucagucguaaccagagaugguguucauguacacccuagagcugcaggacuuguaggcagagacggaccauacgauaaacaaccauucaugguagcauucuucaaaguaucagaaguacauguaagaacaacacgaucugcuagcucaagaagaagacaacaaagucgcaacagaucuacacaaucacaagauguagcacgaguaucaucugcuucagacuauaacuccuccgaacuaaaaacagcaugcaggaaacacgaauuauacguuuccuuccaagauuuaggauggcaagacuggauaauagcacccaaaggauacgcugcaaacuacugcgacggugaauguucauuuccauuaaaugcacauaugaacgcaacaaaccaugcaaucguacaaacucuaguacaccuaaugaauccagaauauguccccaaaccauguugcgcacccacaaaacuuaacgcaauaucagucuuauacuuugacgacaauucaaauguaauccuaaagaaauauagaaacaugguagucagagccugcgguugccauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4951 - RNA, 1643 nt, Artificial Sequence
  mRNA product Design3 comprising derived and/or modified sequence from Homo sapiens__NP_001710.1__HsBMP7 (opt13)
gggagagucccgcagucggcguccagcggcucugcuuguucgugugugugucguugcaggccuuauucaagcuuaccaugcauguaagaucacuaagagcagcugccccacacucauuuguagcacugugggcaccacuuuuuuuacuaagaagcgcauuagcagacuuuucacuagacaaugaaguacauucaagcuuuauucauaggagacuucggucacaagaaagacgugaaaugcaaagagaaauauuaucuauucuaggacuaccacaccgcccaagaccacaucuacaaggaaaacacaauucagcuccaauguucaugcuagaucuuuauaacgcaauggcagucgaagaaggaggaggccccggaggacaaggauuuuccuauccauauaaagcaguauuuucaacacaaggaccuccucuagcaagucuacaagauucacauuucuuaacagaugcagauaugguaaugucauuuguaaauuuaguagaacaugauaaagaauuuuuucacccacguuaccaccauagagaauucagauucgaucuaucuaaaauaccagaaggugaagcaguaacagcagcugaauucagaauauacaaagauuacauacgagaaagauuugacaacgaaacauucagaauaucaguauaucaaguacuacaagaacacuuagguagagaaagcgaucuauuucuauuagacuccagaacacucugggcaucagaagaaggcuggcuaguauucgauauaacagcaaccaguaaucacugggucguaaacccaagacacaaccucggacuacaauuaucaguagaaacauuagacggccaaaguauuaacccaaaacucgcaggacuaauaggaagacacggaccacaaaacaaacaaccauucaugguagcauucuuuaaagcaaccgaaguacacuucagaucaauacgaucaacaggauccaaacaaagaagccaaaauagaucaaaaacuccaaaaaaucaagaagcauuaagaauggcaaauguagcugaaaauucaucaagugaucaaagacaagccugcaaaaaacacgaauuauacguauccuuccgagauuuaggauggcaagacuggauaauagcaccugaaggcuacgccgcauacuacugugaaggagaaugugcauuucccuuaaacucauauaugaacgcaacuaaucacgcuauaguacaaacacuaguacacuuuauaaaucccgaaacaguacccaaaccaugcugcgcaccaacacaacucaacgcuauaucaguauuauauuuugacgacucuucuaacguuauccuaaaaaaauaucgaaauaugguagucagagcauguggcugccacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4952 - RNA, 647 nt, Artificial Sequence; identical to SEQ ID NO: 4400
  mRNA product Design3 comprising derived and/or modified sequence from Homo sapiens__NP_006264.2__HsCCL7 (opt13)

SEQ ID NO: 4953 - RNA, 3971 nt, Artificial Sequence
  mRNA product Design3 comprising derived and/or modified sequence from Homo sapiens__NP_001954.2__HsEGF (opt13)
gggagagucccgcagucggcguccagcggcucugcuuguucgugugugugucguugcaggccuuauucaagcuuaccauguugcuuacuuuaauaauauuacuuccaguugucaguaaauuuucguuugugucauuaucugcaccacaacauuggaguuguccagaagguacgcuagcaggcaacgguaauucuacgugugucgguccagcgccauuucuaaucuuuucucaugguaacuccauuuuuagaauagauacagaagguacaaauuacgaacaauuaguaguugacgcaggagucagcguaauaauggacuuucauuauaaugagaaaagaaucuauuggguagacuuggaaagacaauuacuucagcguguauucuugaauggauccagacaagaaagaguauguaauauagagaaaaauguaucagguauggcuauaaacuggauaaaugaagaagugauuuggucaaaucaacaagaagggaucauuaccguuacagacaugaaaggaaauaauucccacauacuacuaucagcacuaaaauaucccgccaauguugcaguagauccaguggaaagauuuauauuuugguccucagaaguagcaggaucauuauauagagcagacuuagacgguguggguguuaaggcuuuacuagaaacuucugagaaaauuaccgcaguaaguuuagacguuuuagacaaaagauuauuuuggauucaauauaauagggaagguucaaauucacuuauauguucuugcgacuaugaugguggaucagugcauauaaguaaacauccaacgcaacacaaucucuuugcaaugucuuuauuuggugauagaauauuuuacagcacuuggaaaaugaaaacaauauggauagccaacaaacauaccggaaaagauaugguaaggauaaaucuacacaguuccuucguuccuuuaggugaacuaaaaguaguacauccacuagcgcaaccuaaagcggaagaugacacuugggaaccagaacaaaaacuauguaaguuacgaaaaggcaacuguucaucuacagugugcgggcaagacuuacaaagucacuuauguaugugcgcggaaggcuaugcgcucaguagagauagaaaauauugugaagauguaaaugaaugugcauuuuggaaccauggauguacacuaggaugcaaaaauacaccagguucauauuauuguacuugucccguuggauuuguccuguuaccagacggcaaaaggugccaucagcuaguaaguuguccacguaauguuucagaauguagccacgauuguguuuugacaagugaaggaccacuaugcuuuugcccagaaggaucaguauuagaaagggauggaaaaacauguagugguuguaguucaccagauaauggagguuguagucaacuuuguguuccauuaucuccuguaucuugggaaugcgauuguuucccagguuaugauuuacaauuagaugagaaaaguugugcagcgucuggcccacaaccauucuuacucuuugcaaauucacaagauauaagacacaugcauuucgauggcaccgacuacggcacccuauuaagucaacaaauggggaugguauaugcacuugaccaugauccaguagaaaacaaaauauacuucgcacauaccgcacucaaauggaucgaaagagcaaauauggacggaagucaaagggaacgguugauugaagaaggaguagauguaccugaggguuuagcaguugauuggauagggaggagauuuuauuggacggacagggggaaaaguuuaauaggacgaagcgaccucaacgggaaaagaagcaaaauaaucacuaaagaaaauauuucacaaccaagaggaauugcuguacauccaauggcaaaacgucuauuuuggacagacacaggaauaaauccuagaauagaguccaguucacugcaaggauuggggagauuagugaucgccaguuccgaccuaauauggccaucgggaauuacaauagacuuuuuaaccgauaaacuauauuggugcgaugcaaaacagucaguaauugaaauggccaaucuagauggaucuaaaagaagaagacuaacacaaaaugaugugggacacccauuugcuguugccguuuucgaggacuacgucugguuuucagauugggcaaugccaagugucaugagagucaauaagagaacugguaaggauagagucagauuacaaggcucaauguuaaaaccaucgagucuagucguaguccacccauuagcaaaaccaggugcagaucccugcuuauaucaaaauggagggugcgaacacauauguaagaaaagacuuggcacagcaugguguucauguagagaaggauuuaugaaggcuucagauggaaaaaccuguuuagcauuagauggccaucaacuucucgccggaggagaaguugacuugaaaaaccaaguaacaccccuagauauauuaagcaaaacaagaguuagcgaagauaacauaacagaaucucaacauauguuaguagcagaaauuauggucucagaucaagaugacugcgcaccuguaggauguucuauguaugcuagaugcauaucagagggggaagaugcgacaugucaaugcuuaaaaggauuugcaggcgacggaaaauuaugcucagacauagacgaaugugaaaugggaguuccuguuuguccuccagcaucuuccaaauguauaaauaccgaaggugguuauguauguagauguagugaaggauaccaaggggacgguauccauuguuuagauauagaugaaugccaauugggagaacacuccuguggagagaacgcauccuguacaaauacugaaggagguuauacguguaugugcgcaggaaggcuuuccgaaccugguuuaauuugcccagauucaacaccucccccacaccuucgugaagaugaccaccauuauaguguacgaaauucagauucugagugcccacuaagccaugauggauauuguuuacacgauggaguaugcauguacauagaagcguuggauaaauacgcuuguaauugugugguuggauacauaggugaaagaugucaauaccgagaccuaaaauggugggaacuaagacaugccgggcacggacaacaacaaaaaguaauagucguugcaguguguguaguagucuuagucaugcuauuacuauugagccucuggggugcacacuauuauaggacacaaaaacuacuaucuaaaaaccccaaaaauccauaugaagaaucaagucgugaugucagaucaagaagaccagcagacacagaagacggaaugucaucguguccacaaccaugguuugugguaauuaaagaacaucaagaucucaaaaacggaggccaacccguugcuggugaagauggacaagcagcagaugguaguaugcagcccacaucauggcgacaagagccacaauuaugcggcaugggaacagaacaagguuguuggauuccaguuaguucugacaaaggaagcuguccgcaagugauggagaggucauuucauaugccaagcuacggaacacagacacucgaaggcggaguagagaaaccacauucgcuucuuucugcaaacccauuauggcaacaaagagcucuagauccaccucaccaaauggaauugacucaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4954 - RNA, 857 nt, Artificial Sequence
  mRNA product Design3 comprising derived and/or modified sequence from Homo sapiens__NP_001423.1__HsEREG (opt13)
gggagagucccgcagucggcguccagcggcucugcuuguucgugugugugucguugcaggccuuauucaagcuuaccaugacagcaggcagaagaauggaaaugcuaugugcaggacgaguaccagcauuauuacuaugucuaggauuccauuuauuacaagcaguacuaagcacaacaguaauaccaagcuguauaccaggagaaagcucagacaauugcacagccuuaguacaaacagaagacaauccaagaguagcacaaguaaguauaacaaaaugcucaagcgauaugaauggauauugcuuacacggacaauguauauaucuaguagacaugagccaaaacuauugcagaugcgaagucggauacacaggaguaagaugugaacauuucuucuuaacaguacaucaaccacuaucaaaagaauacguagcauuaacaguaauauuaauaauacuauuucuaauaacaguaguaggaagcacauacuauuucuguagaugguacagaaacagaaaaucgaaagaaccaaaaaaagaauacgaacgaguaacaucaggagauccagaacuaccacaaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4955 - RNA, 815 nt, Artificial Sequence
  mRNA product Design3 comprising derived and/or modified sequence from Homo sapiens__NP_000791.1__HsFGF1 (opt13)
gggagagucccgcagucggcguccagcggcucugcuuguucgugugugugucguugcaggccuuauucaagcuuaccauggcagaaggagaaauaacaacauucacagcacuaacagaaaaauucaaccuaccaccaggaaacuacaaaaaaccaaaacuacuauacugcucaaacggaggacacuuccuaagaauacuaccagacggcacaguagacggaacaagagacagauccgaccaacacauacaacuacaacuaucagcagaaucaguaggagaaguauacauaaaaucaacagaaacaggacaauaccuagcaauggacacagacggacuacuauacggaucacaaacaccaaacgaagaaugccuauuccuagaaagacuagaagaaaaccacuacaacacauacauaucaaaaaaacacgcagaaaaaaacugguucguaggacuaaaaaaaaacggaagcugcaaaagaggaccaagaacacacuacggacaaaaagccauacuauuccuaccacuaccaguaucaucagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4956 - RNA, 1214 nt, Artificial Sequence
  mRNA product Design3 comprising derived and/or modified sequence from Homo sapiens__NP_001997.5__HsFGF2 (opt13)
gggagagucccgcagucggcguccagcggcucugcuuguucgugugugugucguugcaggccuuauucaagcuuaccaugguaggaguaggagggggagauguagaagauguaacaccaagaccagguggaugucaaauuagcggaagaggugcaagaggauguaauggaauaccaggagcagcagcuugggaagcagcauuaccgagaagacgaccgagaagacauccgagugugaauccaagaucaagagcagcuggaagcccaagaacaagaggaagaagaacagaagaaagaccaaguggaagcagauuaggagauagaggaagaggacgagcauuaccaggaggaagauuaggaggaagaggaagaggaagagcaccagagagaguaggagggagaggaagaggaagaggaacagcagcgccaagagcagcaccagcagcaagaggaucaagaccaggaccagcaggaacaauggcagcgggaaguauaacaacauuaccagcucuaccagaagauggaggaaguggggcguuuccaccaggacauuuuaaagauccaaaaagauuauauuguaaaaauggaggauuuuuuuuaagaauacauccagauggaagaguagaugggguaagagaaaaaucagauccacauauaaaauuacaauuacaagcggaagaaagaggagugguaaguauuaaaggaguuugugcaaauagauauuuggcgaugaaagaagaugggagguuauuagcaaguaaauguguaacggaugaauguuuuuuuuuugaaagacuagaaagcaauaacuauaacacauauagaucgagaaaauacacaucaugguauguagcauuaaaaagaacaggacaauauaaacuaggaaguaaaacaggaccaggacaaaaagcaauauuauuuuuaccaaugagugcaaagaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4957 - RNA, 932 nt, Artificial Sequence
  mRNA product Design3 comprising derived and/or modified sequence from Homo sapiens__NP_002000.1__HsFGF7 (opt13)
gggagagucccgcagucggcguccagcggcucugcuuguucgugugugugucguugcaggccuuauucaagcuuaccaugcacaaauggauacuaacauggauacuaccaacacuacuauacagaagcugcuuccacauaauaugccuaguaggaacaauaucacuagcaugcaacgacaugacaccagaacaaauggcaacaaacguaaacugcucaucuccagaaagacacacaagaucauacgacuacauggaaggaggagacauaagaguaagaagacuauucugcagaacacaaugguaccuaagaauagacaaaagaggaaaaguaaaaggaacacaagaaaugaaaaacaacuacaacauaauggaaauaagaacaguagcaguaggaauaguagcaaucaaaggaguagaaucagaauucuaccuagcaaugaacaaagaaggcaaacuauacgcaaaaaaagaaugcaacgaagacugcaacuucaaagaacuaauacuagaaaaccacuacaacacauaugcaagcgcaaaauggacacacaacggaggagaaauguucguagcauuaaaccaaaaaggaauaccaguaagaggaaaaaaaacaaaaaaagaacaaaaaacagcacacuuccuaccaauggcaauaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4958 - RNA, 974 nt, Artificial Sequence
  mRNA product Design3 comprising derived and/or modified sequence from Homo sapiens__NP_001936.1__HsHBEGF (opt13)
gggagagucccgcagucggcguccagcggcucugcuuguucgugugugugucguugcaggccuuauucaagcuuaccaugaaauuauuaccaucaguaguacuaaaacuauuucuagcagcaguacuaucagcauuaguaacaggagaaagccuagaaagacuaagaagaggacuagcagcaggaaccucaaacccagacccaccaacaguaucaacagaucaauuacuaccacuaggcggaggaagagauagaaaaguaagagacuuacaagaagcagaccuagauuuacuaagaguaacauuaucaucaaaaccacaagcacuagcaacaccaaacaaagaagaacacggaaaaagaaaaaaaaaaggaaaaggauuaggaaaaaaacgagauccaugccuaagaaaauauaaagacuucugcauacauggagaaugcaaauacgucaaagaacucagagcaccaagcugcauaugucacccuggauaccacggagaaagaugccacggacuaagucuuccaguagaaaacagauuauacacauacgaccacacaacaauacuagcaguaguagcaguaguauuaagcucaguaugucuauuaguaauaguaggucuacuaauguucagauaucaccgaagaggaggauacgauguagaaaaugaagaaaaaguaaaacuaggaaugacaaauagccacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4959 - RNA, 2534 nt, Artificial Sequence
  mRNA product Design3 comprising derived and/or modified sequence from Homo sapiens__NP_000592.3__HsHGF (opt13)
gggagagucccgcagucggcguccagcggcucugcuuguucgugugugugucguugcaggccuuauucaagcuuaccauguggguaacuaaacuauuaccagcauuacuauuacaacauguccuacuacaccuacuauuacuaccuauugcaauaccauacgccgaaggucaaagaaaacgaagaaauacaauacaugaguucaaaaagucagcaaaaacaacauuaaucaaaauagacccagcacuaaaaauaaaaacaaagaaaguaaauacagcagaucaaugugcaaacagaugcacuagaaacaaaggacuaccauuuacauguaaagcauucguauuugauaaagcaagaaaacaaugucuaugguuuccauuuaauagcaugaguucaggaguaaagaaagaguucggacaugaauuugaccuauaugaaaauaaagacuauauaagaaauugcauaauagguaaaggaagaucauauaaaggaacaguuuccaucacaaaaucaggaauaaaaugucaacccuggucaucaaugauaccacacgaacauagcuuucuaccaagcucauacagagguaaagaucuacaagaaaauuauuguagaaauccgagaggugaagaaggcggaccaugguguuuuacuucuaauccagaaguacgauaugaaguaugugauauaccgcaaugcucagaaguagaauguaugacauguaacggagaaucauauagagguuugauggaucauacagaaucaggcaaaauaugucaaaggugggaccaccaaacuccacaucgacauaaauuucuaccagaacguuauccagauaaaggcuuugaugauaauuacugucgaaacccagacggacaaccaagaccuuggugcuacacauuagauccccauacucgaugggaauacugugcaauaaaaacaugcgcagauaacacaaugaaugacacagauguuccucuagaaacuacugaaugcauacaaggacaaggagaaggauaccgaggaacuguaaauacaauauggaauggaauaccuugucaaagaugggauucacaauauccucaugaacaugacaugaccccagaaaauuuuaaaugcaaagaucuaagagaaaauuauugcagaaacccagacggaucugaaucgccaugguguuuuacaacugauccuaacauaagaguaggcuauugcucucagauaccgaauugcgacaugagccauggacaagacuguuauagaggaaauggcaaaaauuacaugggaaaucucagucaaacaagaucaggauuaacuuguucaaugugggacaaaaauauggaagauuuacauagacacauauucugggaaccagacgcaucaaaauuaaaugaaaacuauugcagaaauccagaugacgacgcacacgggccaugguguuauacaggaaauccauuaauaccaugggacuacuguccuauaagccgaugugaaggagauacaacucccacaauuguaaacuuagaucauccaguaaucucaugugccaaaacaaaacaauuaagagucguaaacgguauaccuacuaggacaaacauaggcuggauggugucacuuagauauagaaauaaacacauaugcggaggcagucuuauaaaagaaucauggguccucacagcaagacaauguuuucccagcagagauuuaaaggacuaugaagcaugguuaggaauacacgauguacacggacgaggagacgaaaaauguaaacaaguacuaaauguuucucagcuagucuauggaccagaagggagcgauuuagucuuaaugaaacuagcaagaccggcagucuuagacgacuucguaucuacaauugauuuaccuaacuacggaugcacgauaccagaaaagacuagcuguucuguuuauggaugggguuauacuggacuaaucaacuacgacggacuauuaaggguggcacauuuauauauuaugggaaacgaaaaauguucucaacaccacagaggaaaaguaacauuaaacgaaucagaaauaugcgcaggagcagagaaaaucggaucaggcccgugugaaggagacuauggugggccgcuagugugcgaacaacacaaaaugcgaaugguauuagggguaauaguaccuggacggggaugcgccauaccaaauagaccaggaauauucguaagaguagcauauuaugccaaauggauacauaaaauaauacuaacauauaaaguaccacaaucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4960 - RNA, 2273 nt, Artificial Sequence
  mRNA product Design3 comprising derived and/or modified sequence from Homo sapiens__NP_005336.3 __HsHSPA1A (opt13)
gggagagucccgcagucggcguccagcggcucugcuuguucgugugugugucguugcaggccuuauucaagcuuaccauggccaaagcagcugcaauaggaauagaucuaggaacaacauacuccuguguaggaguauuccaacacggaaaaguagaaauaaucgcaaaugaucaagguaacagaacaacaccaucauacguugcauuuacagacacagaaagauuaauaggagaugcagccaaaaaccaagucgcacuaaauccacaaaacacaguauuugaugcaaaacgcuuaauaggaagaaaauuuggcgauccaguaguacaaucagacaugaaacauuggccauuucagguaauaaacgauggagauaaaccaaaaguucaaguuaguuacaaaggcgaaacuaaagcauuuuacccggaagagauaucaagcaugguauuaacaaaaaugaaagaaaucgcagaggcuuauuuaggauacccaguaacaaacgcaguaauaacaguaccagcuuacuuuaaugauagucagagacaagcaacuaaagaugccggaguaauugccggacuaaacguacuaagaauaauaaacgaaccaacugcagcagcaauagcauauggauuagauagaacaggcaaaggagaaagaaauguauuaauauucgaccuaggaggagguacauucgacgugucaauauuaacaauugaugauggaauauucgaaguaaaagcaacagccggggacacacauuuagggggagaagauuuugacaacagacugguaaaccauuuuguagaagaauuuaaaagaaaacacaagaaagacauuucacaaaauaaaagggcaguuagaagacuaagaacugcaugugagagggcaaaaaggacguuaagcaguaguacccaagcaucacuagagauagacucauuauuugaaggaauugauuuuuauacuucaaucacgagagcgagauuugaagaauuauguagugaucucuuuagaucgacauuagaaccugucgaaaaagcacuaagagaugcgaaacuagacaaagcacaaauacaugacuuaguucuaguaggaggaucaaccagaauaccaaaaguacaaaaacuacuacaagauuucuucaacggaagggacuuaaauaaaucaauaaacccagaugaagcugucgcuuacggugcagcuguccaagcagcaauacuaaugggagauaaaagcgagaaugugcaagacuuauuauuauuagacguugcaccucuaucgcuaggacuagaaacagcaggaggaguaaugacagcacuuauaaaaagaaacagcacaauaccgacuaaacaaacgcaaauauuuacaaccuauucagauaaccaaccuggcguccuuauacagguuuaugaaggugaaagagcaaugacaaaagauaacaaucuacuaggaagauuugagcuaaguggaauaccaccagcaccucgaggaguaccacaaauagaaguuacauucgacauagacgcuaauggcauucuaaaugugacagcuacugacaaaaguaccggaaaagcaaauaaaauaacuauuacaaacgauaaaggaagacuaagcaaggaagagauagaacgcaugguacaggaagcagaaaaauacaaagcggaagacgagguccagcgagaaagaguaagcgcuaaaaacgcauuagaaucauaugcauucaacaugaaaagcgcaguagaagaugaaggacuaaaagguaaaauaagcgaagcagauaaaaagaaaguacuagauaaaugucaagaaguuauaaguugguuagaugcaaauacuuuagcggaaaaagaugaauuugaacauaaaagaaaagaacuagaacagguaugcaauccuauuauaucaggauuauaccaaggagcuggaggaccaggaccaggaggcuucggagcacaaggaccgaaaggaggauccggaucagggccaacaauagaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4961 - RNA, 2273 nt, Artificial Sequence
  mRNA product Design3 comprising derived and/or modified sequence from Homo sapiens__NP_005337.2 __HsHSPA1B (opt13)
gggagagucccgcagucggcguccagcggcucugcuuguucgugugugugucguugcaggccuuauucaagcuuaccauggcaaaagcugcagcaauaggaauagaccuaggaacaacauacuccugcguaggaguauuucagcaugguaaaguugaaauaauagcuaacgaccaaggcaacagaacaacccccucauacgucgcauucacagauaccgaaagauuaaucggagaugcggcuaaaaaccaaguggcacucaauccacaaaacacaguauuugacgcaaaaagacugauaggaagaaaauucggcgauccagugguucaaucagauaugaaacauuggccauuccagguaauaaaugauggagauaaaccaaaaguacaaguaucauauaaaggagaaacaaaagcauuuuauccagaggaaauaaguaguaugguauuaacaaaaaugaaagaaauagcugaagcauaucucggauacccaguaacaaacgccguaauaacaguuccagcauauuucaacgacagucaaagacaagcaacaaaagaugcaggaguaauagcuggccuaaauguacuuagaauaauaaaugaaccuacugcugcugccauagcauacggacuagaucgaacaggcaaaggagaaagaaauguuuuaauauucgaccuuggaggaggaacauucgacguaagcauuuuaacaauagaugauggaauauuugaaguuaaagccacugcaggggauacucaccuaggaggagaagauuucgauaacaggcuaguuaaucauuuuguagaagaauuuaaaagaaaacauaagaaagacauaagucaaaacaaaagagcaguaagaagauugagaacagcaugugaaagagcuaaaagaacgcuaagcucaagcacacaagcaaguuuagaaauagauaguuuauuugaaggaauagauuuuuauacuucgauaacgagagcaagauuugaagaauuauguucagauuuauuuagaucaacguuagaaccaguugaaaaagcacuaagagacgcaaaauuagauaaagcucaaauacaugaccuagucuuggucggaggcucaacacgaaucccuaaaguacaaaaauuacuucaagauuucuuuaacgguagagaucuaaauaaaucaauaaaucccgacgaagcuguagcauauggagcagcuguacaagccgcaauucuuaugggagauaaaucagaaaauguacaagauuugcuacuuuuagacguggcaccacuuagccuaggacuagaaacagcuggaggaguaaugaccgcauuaauaaaacgcaacucgacuauaccaacaaaacaaacacaaaucuuuacaacauacagugauaaucaaccaggaguacuaauacaaguauaugaaggagaaagagcaaugacuaaagacaauaaucuacuaggacgguucgaacuaagcggcauuccaccagcaccucgaggaguaccacaaauugaaguaacauuugauauagacgcaaacgggauauuaaacguuacagcaaccgauaaaagcacaggcaaagcaaacaaaauaacaauuacaaaugauaaaggaagacuuucaaaagaagaaauagagagaaugguacaagaagcugagaaauacaaagccgaagacgaaguccaaagagaaagaguuagcgcuaaaaacgcacuggaaucauaugcuuucaauaugaaaucagcaguagaggacgaaggacuaaaaggcaaaauuucagaagcagacaaaaagaaaguacuagauaaaugucaagaaguaauuagcugguuagaugcaaauacccuggcagagaaagaugaauuugaacauaaaagaaaagaauuagaacaaguaugcaaucccauaauaucaggucuguaucaaggagcaggcgggccaggaccaggaggauuuggagcacagggaccaaaagguggauccgguagcggcccaacaaucgaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4962 - RNA, 2273 nt, Artificial Sequence
  mRNA product Design3 comprising derived and/or modified sequence from Homo sapiens__NP_005518.3 __HsHSPA1L (opt13)
gggagagucccgcagucggcguccagcggcucugcuuguucgugugugugucguugcaggccuuauucaagcuuaccauggcaacagcaaaaggaauagcaauaggaauagacuuagggacaacuuacaguuguguuggaguauuucagcacgggaaagucgaaauaauagcaaacgaucaagguaauaggaccaccccuucguacguagcauuuacagauacugaaagacuaauaggugaugcagcgaaaaaccaagucgcaaugaacccgcaaaauacaguauuugacgcaaaacgguuaauuggaagaaaguuuaacgacccaguuguacaagcagauaugaaauuauggccauuccaaguaauaaacgaaggaggaaaaccuaaaguguugguauccuauaaaggcgaaaacaaagcauuuuauccggaagaaauaucaucaaugguacuaacaaaacuuaaagaaacggcagaagcauuucuaggacauccagucacaaacgcaguaauaacaguuccagcauacuuuaacgauagucaaagacaagcaacgaaagaugcaggaguuauagcaggucuaaauguacuuaggauaaucaacgaaccaacggcagcagcaauagcauacggacuagauaaaggaggacaaggagaaagacauguacuaauauuugauuuaggcggaggaacauucgacguaaguauauuaaccauagaugauggaauauucgaaguaaaagcaacagcaggggacacacacuuaggaggcgaagacuucgauaacaggcuaguaagccauuuuguagaagaguucaaaagaaaacacaagaaagauauaucacaaaauaaacgcgcaguacgaagacucagaacagcuugcgaaagggcaaaaagaaccuuaagcucuaguacacaagcaaaccuggaaaucgauaguuuauacgaaggaauagauuucuauacaucaaucacuagagcuagauuugaagaacucugugcagaucuauuuagaggaacauuagaacccguagaaaaagcgcuuagagacgccaaaauggacaaagcaaaaauacaugacauaguccuaguagguggaaguacgcguauaccaaaaguacaaagauuauuacaggauuauuucaacggaagagaucuuaacaaaaguauaaaucccgaugaagcaguagcauacggugcagcaguacaggcagcaauacuaaugggagauaaaucugaaaaaguacaagacuuacuacuguuagacguagcaccacuuucacuaggacuagaaacagcuggagguguaaugacagcauuaauaaaaagaaauucaacuauaccaacuaaacaaacacaaauauuuacaaccuauagugacaaucaaccaggaguacuaauacaaguauaugaaggagaaagagcaaugacaaaagauaacaaucugcuaggaagauuugaucuaacgggaauaccaccagcaccaagaggaguaccacaaauagaaguaacguuugacauugaugcaaauggaauacuaaacgugaccgccacagauaaaaguacuggaaaagucaauaaaauaacuaucacaaacgauaaagggagacuaagcaaagaagagauagaaagaaugguuuuagaugcagaaaaauacaaagcagaagacgagguacaaagagagaaaauagcagcuaaaaaugcauuagaaucauaugcauuuaauaugaaaagcguaguaucagacgaaggauuaaaaggaaaaauaagcgaaagugauaaaaacaaaauacuagacaaaugcaaugaacuauuaucaugguuagaaguaaaucagcuagcagaaaaagaugaauuugaccauaaaagaaaggaacuagaacaaauguguaauccaauaauaacaaaauuauaccaaggggguugcacaggaccugcauguggaacaggauaugucccaggcagaccagcaacaggaccaacgaucgaagaaguggauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4963 - RNA, 2267 nt, Artificial Sequence
  mRNA product Design3 comprising derived and/or modified sequence from Homo sapiens__NP_068814.2 __HsHSPA2 (opt13)
gggagagucccgcagucggcguccagcggcucugcuuguucgugugugugucguugcaggccuuauucaagcuuaccaugucagcacgugggcccgcgauagguauagaucuagggacaacauacagcugcguugggguguuucaacacggaaaaguagaaauaauagcaaaugaucaagguaacagaaccacaccaaguuacguugcauuuacagauacugaaagguuaauaggagacgcagcgaaaaaccaaguagccaugaacccaacaaauacgaucuuugacgcaaaacgucuuauaggacguaaauuugaggacgcgaccguccaaagcgauaugaaacacuggccauuuagaguaguaagcgaaggaggaaaacccaagguacaaguagaauacaaaggagaaacaaaaaccuuuuucccugaagaaauaucaucaaugguauuaacaaaaaugaaagaaauagcagaagccuaccuugggggaaaaguccacucagcaguaauaacgguaccagcauacuuuaacgauagccagagacaagccacaaaagaugcagggacaauaacaggacucaauguauuaagaauaauuaaugagccuacagcagcagcaauagcauauggauuagauaagaaaggaugugcggguggggaaaagaacguauuaauauuugaccuagguggaggaacauucgacguaaguauacuaacaauagaagauggaaucuucgaagugaaaaguacagcaggagauacucaccugggcggagaagauuuugauaaucgaaugguuucacauuuagcagaagaguucaaacgaaagcacaagaaagauauaggaccaaacaaaagagcaguacgaagauugcgaacagcgugcgaaagagcgaaaagaacacugaguucaucaacacaagcgagcauagaaauagacucacuuuaugaaggaguagauuuuuauacaaguauaacacgcgcaagauuugaagaguuaaaugcagauuuauucagaggaacguuagaaccgguugagaaagcacuaagagacgcaaaacuugacaaaggccaaauacaagaaauaguauuagucggcggaucaacuagaauaccaaaaauacaaaaacuacugcaagacuucuuuaauggaaaagaacucaacaaaagcauaaauccagacgaagcagucgcauauggugcagcaguacaagcagcaauauuaauaggggauaaaucagaaaacgugcaagaucuacuguuacuagaugucacaccacuaucacuagguauagaaacagcaggggguguaaugacaccucuaauaaaaagaaauacaaccauuccaacaaaacaaacacaaacauuuacaaccuacucagauaaucaaucaagcguucuaguacaaguauaugaaggugaaagagcaaugacgaaggauaauaauuuauuaggaaaauucgaucucacagguauaccaccagcgccccgaggaguaccacaaauugaaguaacuuuugacauagaugcaaacggaaucuuaaauguuacagcagcagauaaaagcaccggaaaagaaaauaaaaucacuauaacgaaugauaaaggaagauuaagcaaagaugauauagauagaaugguacaagaagcggaaagauacaaaagugaagacgaagcaaauagagauagaguggcagccaaaaaugcacuagaaagcuauacauauaauaucaaacaaacagucgaagaugaaaaacuaagaggaaagauaucagaacaagauaaaaacaaaauauuggacaaaugucaagagguaauaaacugguuagauagaaaucaaauggcugaaaaggaugaauaugaacauaaacaaaaagaauuagaaagaguaugcaauccuauaauaucaaaacuauaucaaggaggaccaggaggaggaagcggaggaggaggaagcggcgcaucagguggaccaaccauagaggaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4964 - RNA, 2870 nt, Artificial Sequence
  mRNA product Design3 comprising derived and/or modified sequence from Homo sapiens__NP_002145.3 __HsHSPA4 (opt13)
gggagagucccgcagucggcguccagcggcucugcuuguucgugugugugucguugcaggccuuauucaagcuuaccaugaguguuguugguauugauuuaggcuuccaaagcugcuauguggcaguugcacgagcgggaggcauagaaacaauagcaaaugaauacagcgaucgaugcacccccgcauguaucucauucggaccuaaaaacagaucaaucggagcagcggcaaaaucacaaguaauuucaaaugcgaaaaacacuguacagggauucaaaagauuucauggaagggcauucagugacccauuuguagaagcugaaaagaguaacuuggcuuaugauauagugcaacuaccaaccggcuuaacaggaauaaaaguaacauacauggaagaagaaagaaacuuuacaacagaacaaguuaccgcaauguuacuuaguaaauuaaaagaaacugcagaaagcguguuaaagaaaccaguaguagauuguguugugaguguacccugcuuuuacacagaugcggaaaggagaucuguaauggacgcuacacaaauagcgggacuaaacugcuuaagacuaaugaaugaaacaacagcagucgcauuagccuacggcauuuauaaacaagacuuacccgcauuagaagaaaaaccaagaaacguaguuuuuguggacaugggacacucagcauaucaaguaucagugugugcauuuaauagaggcaaacuaaaaguauuagcaacagcauuugacaccacacuaggaggaaggaaauucgaugaaguacuuguaaaccauuucugugaagaguucggcaagaaauauaaacuagauauaaaaucaaaaauaagagccuuauuacgacuuucacaagaaugugaaaaauuaaagaaacugaugucagcaaaugccuccgaucugccacuaaguauagaaugcuucaugaaugauguagaugucucaggaacgaugaaccgcgguaaauuuuuagaaaugugcaaugaucuauuggcaaggguagaaccaccgcuuagaagcguccuagaacaaaccaaacuaaagaaagaagauauauaugcuguagaaauugucggaggagcaacaagaaucccagcaguaaaagagaaaauaaguaaauucuuuggaaaagaauuaucaacaacgcuaaaugcagacgaagccguaacacgaggaugcgcauuacagugugccauacuaaguccagcauucaaaguaagagaguucaguauaaccgacguuguaccauacccuauaaguuuaagguggaauagucccgcagaagaagguagcucagauugugaaguauuuucuaaaaaucacgcagcaccauuuucaaaaguauuaacauucuacagaaaagagccuuuuacacuagaggcuuauuauucaucaccccaagaccuaccauacccugauccagcuauagcacaauucagcguacaaaaagugacaccacaaagcgaugggaguagcucaaaaguaaaaguaaaaguaagagucaacguacauggaauauuuucaguaaguagugcaagccuaguagaaguacauaaaucagaagaaaaugaagaaccuauggaaacagaucaaaacgcgaaagaagaagagaaaaugcaaguugaucaagaagaaccccaugucgaagaacaacaacaacaaacaccagcugaaaauaaagcagaaagcgaggaaauggaaaccagccaagcuggauccaaagacaagaaaauggaucaaccaccccaagcaaagaaagcaaaaguaaaaacuagcacagucgacuuaccaauagaaaaccaacuccuauggcagaucgacagggaaaugcuaaaucucuauauagaaaaugagggaaaaaugauaaugcaggacaaacuagaaaaagagaggaacgacgcuaaaaacgcaguagaagaauacguauacgaaaugagagauaaacuaucaggggaauaugaaaaauuuguaucugaagaugauagaaacaguuuuacauuaaaauuggaagauacugaaaacugguuauacgaagauggcgaagaccaaccaaaacaaguauacgucgacaaacuagcugaacuaaagaaucuaggucaaccaauaaaaauaagauuccaagaaucagaagaaagaccaaaauuauucgaagaacuaggaaaacaaauacaacaauauaugaaaauaaucucaucauuuaaaaauaaagaagaccaauacgaccaucuagaugcagcagauaugacaaaaguagaaaaaucuacuaacgaagcaauggaauggaugaauaauaaauuaaaccuccaaaauaaacaaucacugacgauggaucccguuguuaaaagcaaagaaauagaggcaaaaauaaaagaacuaacaagcacguguagucccauaauaucaaaaccaaaaccaaaaguagaacccccaaaagaagaacagaaaaaugccgaacaaaaugguccaguagauggacaaggagacaauccaggcccacaagcagcagaacaaggaacagauacagccgugccaucagauagugacaagaaauuaccagaaauggauauugauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4965 - RNA, 2867 nt, Artificial Sequence
  mRNA product Design3 comprising derived and/or modified sequence from Homo sapiens__NP_055093.2 __HsHSPA4L (opt13)
gggagagucccgcagucggcguccagcggcucugcuuguucgugugugugucguugcaggccuuauucaagcuuaccaugagcguuguuggcauagaucucggauuccuaaacugcuauauagccguagcuagaagcgguggaauagaaacaauagcgaacgaauacucggaccgcugcacaccagcuuguaucagcuuaggaucccgcaccagagcaauaggcaaugcagcgaaaagccaaauagugacaaacguacgaaauacuauacauggauuuaaaaaacuacacggaaggaguuucgaugacccuauaguacaaacggaaagaauacgacucccauaugaacuacaaaagaugccgaauggaagugcaggaguaaaaguaagauaccucgaagaagaaagacccuuugcaauugaacaaguaacuggaauguuacuagcaaaauuaaaagaaacaucggaaaacgcauuaaaaaaaccgguugccgacugcguaauauccaucccaaguuuuuuuacggaugcagaaagaagaaguguaauggcggcagcacaaguagcaggauuaaauugccuaaggcucaugaacgaaacgacagcaguagcuuuagcauacggaauuuauaaacaagauuugccaccauuagaugagaaacccagaaauguaguauucauagacaugggacacucugccuaucaaguacucguuugugcauucaauaaaggcaaauuaaaaguuuuagccacaacauucgaucccuaccucggcggaaggaauuucgacgaagcauuaguagauuauuuuugcgaugaauucaaaacaaaauacaaaauaaaugugaaagaaaacuccagagcauuacucagacuauaccaagaaugugaaaaacuaaaaaaacuaaugagcgcaaaugcaagcgaccucccccuaaacauagaaugcuuuaugaaugacuuggacguaucuucaaaaaugaacagagcccaauucgagcaauuaugcgcgucauuacuagcccgaguagaaccuccacuuaaagcaguaauggaacaagcaaacuuacaacgagaagauauaucaucuauagagauuguaggaggagcaacaagaauccccgcaguaaaagaacagaucacuaaguuuuuuuuaaaagacauuucuacaacacucaaugccgaugaagccguugcacgaggaugugcauuacaaugcgccauauuauccccagcauuuaagguaagagaauucagcauuacagaccugguuccauauucaauaacauuaagauggaaaacaaguuuugaagacggaucaggugaaugcgaaguauucugcaaaaaccauccagcaccauucucuaaaguaauuacauuccauaaaaaagaaccauuugaacuagaagcuuuuuauacuaaccuacacgaaguaccauacccagaugcaaggaucgguucauuuacaauacaaaacguguucccgcaaagcgacggagacucuaguaaagugaaaguuaaaguaagagucaauauacauggaauauuuucagucgccucagccucagugauagaaaaacagaacuuagaaggagaccauagugacgcuccuauggaaacugaaacauccuucaaaaaugaaaauaaagacaauauggauaaaaugcaaguagaccaggaagaaggacaucagaaaugccaugccgaacauacuccugaggaagaaauagaucauacaggagcaaaaacaaaaucggcaguaucagauaaacaagacagauuaaaucaaacucuaaaaaaagggaaaguuaaaucaauagacuuaccaauacaaucgagcuuaugcagacaguuaggacaagaccuacuuaacucauauauugaaaaugaaggcaaaaugauuaugcaagacaaauuagaaaaggagaggaacgaugccaaaaacgcagucgaagaauacguauaugacuucagagauagacuaggaacuguauaugaaaaauuuauuaccccagaagacuuaucgaaacuaagcgccguucuagaagauacagaaaacuggcuguaugaggauggagaagaucaacccaaacaaguauacguugacaaacuacaagaauugaaaaaauacggacaaccaauccaaaugaaauacauggaacacgaagaaagaccaaaagcauuaaaugaucucggaaaaaaaauccaauuaguaaugaaaguaauagaagccuaucguaauaaagaugaaagauacgaucaucuagacccuacagaaauggaaaaaguagaaaaauguauaucagaugcaaugaguugguuaaauucaaaaaugaacgcacaaaauaaacuaaguuuaacgcaagacccuguaguaaaagucucugaaaucguagcaaaaagcaaagaacuggacaacuucugcaaccccauaauauacaaacccaaaccuaaagcagaggugccagaagacaaacccaaagcaaauucugaacauaacgguccaauggacggacaaagcggaacagaaacaaaaucagacucaacaaaagauaguucacaacauacaaagucaucuggcgaaauggaaguugacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4966 - RNA, 2312 nt, Artificial Sequence
  mRNA product Design3 comprising derived and/or modified sequence from Homo sapiens__NP_005338.1__HsHSPA5 (opt13)
gggagagucccgcagucggcguccagcggcucugcuuguucgugugugugucguugcaggccuuauucaagcuuaccaugaaauuaucuuuaguagcggcaaugcuauuacuacuaagcgcagcaagggcagaggaagaagauaaaaaagaagacgucggaacaguagucgguauagaccuaggaaccacauauucaugcgucggaguuuuuaaaaacggaagaguugaaaucauagcaaacgaucaaggaaacagaaucacaccaucauacguagcguucacaccugaaggagaacgacucauaggagaugcagcaaaaaaucaauuaacaucuaacccugaaaacacagucuuugacgcaaaaagauugauaggaagaaccuggaacgacccuucaguucaacaagacauaaaauuucuaccauuuaaaguaguagaaaaaaaaacaaaaccauauauacaaguugauauuggaggcggucaaacaaaaacauucgcaccagaagaaauauccgcaaugguacuuacaaaaaugaaagaaacagcugaagcauaccuaggaaaaaaaguaacacaugccguaguaacaguaccagcauauuuuaaugacgcccaaagacaagcaacaaaggaugcaggaacaauagcuggucuaaacgucaugagaauaauaaacgaaccaacagcagcagcuaucgcauacggacuagauaaaagagaaggagaaaaaaauauacuaguauuugaucuaggaggaggaacauucgauguaagcuuauuaacaauagacaacggagucuuugaaguaguagcuacaaacggugacacacauuuaggaggagaagacuuugaucaaagaguuauggaacacuuuauaaaacuauauaaaaaaaaaaccgggaaagacguaaggaaagauaacagggccguacagaaacucagaagagaagucgaaaaagcaaaacgagcauuaucaucacaacaccaagcaagaauagaaauagaaaguuucuaugaaggagaagauuuuagcgaaacucuaacgcgagcaaaauuugaagagcugaacauggauuuauuuagaaguaccaugaaaccaguacaaaaaguacucgaagacagugauuuaaaaaaaagugacauagacgaaauaguccuaguaggagguucaacccgaauccccaaaauacaacaacucgucaaagaauuuuucaacggaaaagaaccgagccgaggaauaaacccugacgaagcaguagcauauggcgcagcaguucaagcaggcguauuaagcggagaucaagauacaggagauuuaguacuacuagacguauguccacuaacucuaggaauagaaacagucggaggaguaaugaccaaauuaauaccuagaaacacaguaguaccgacaaaaaaaucacaaauuuucuccacagcaagcgacaaucaaccaacaguaaccauaaaaguauacgaaggcgaaagaccauuaacaaaagauaaccauuuauuaggaacauuugauuuaacagguaucccaccugccccacgaggagucccacaaauagaaguuacauuugaaauagauguaaaugguauccucagagucacagcggaagauaaaggcacuggaaauaagaauaaaauuacuauaacaaacgaccaaaauagauuaacucccgaagaaauagaaagaaugguaaaugaugcggaaaaauucgccgaagaggacaaaaaacuaaaagagagaauagauaccagaaacgaguuagaaucauacgcauacucccuuaagaaucaaauuggagauaaagaaaaauuaggcggcaaauugagcucagaagacaaagaaaccauggaaaaagcaguagaagaaaaaauagaauggcuugaaagccaccaggaugcagauauagaagauuucaaagcaaaaaaaaaagagcuagaggaaaucguacaaccaauaauuucaaaacuauacggaagugcagggccaccaccaacaggagaagaagacaccgcagaaaaagaugaacuuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4967 - RNA, 2279 nt, Artificial Sequence
  mRNA product Design3 comprising derived and/or modified sequence from Homo sapiens__NP_002146.2__HsHSPA6 (opt13)
gggagagucccgcagucggcguccagcggcucugcuuguucgugugugugucguugcaggccuuauucaagcuuaccaugcaagcaccacgugaacuugcagucgguauagaucuaggaacaacauauuccuguguaggaguauuucaacaagggagaguagaaauauuagcaaacgaucaaggcaauagaacaacaccaucauauguagcauuuacugacacagaaagauugguaggagaugcagccaaaagucaagcagcauuaaauccacauaacacaguguucgacgcgaaaagacuaauugguagaaaauuugcggauacaacaguccaaagugacaugaagcauuggccauuuaggguagugucugaagguggaaaaccaaaaguaagaguaugcuauagaggugaagauaaaacauuuuauccagaagaaauuucaucaaugguauuaagcaaaaugaaagagacagcagaagcauaccuuggacaaccaguaaaacaugcuguaauaacaguucccgcauacuucaaugauagccaaagacaagcaacaaaagaugcuggagcaauagcuggauuaaacgugcuaagaauuauaaaugaaccaaccgccgcggcaauugcauauggauuagauagaagaggagcaggagaaagaaacguauuaauauucgaucuaggaggaggaacauuugacguaucagucuuaucaauagacgcaggcguauucgaaguaaaagcaacagcuggugauacucacuuaggaggagaagauuucgauaacagauuaguuaaucacuucauggaagaauuucgacgaaaacauggcaaagaucuauccggcaauaaaagagcauuaagaagacuacgaacagcgugugaaagagcaaaaagaacauuauccucaucuacccaagcuacauuagaaauagauagccuauucgaagggguagauuuuuacacuuccauaacaagagcucgcuucgaggaacuaugcucagauuuauuuagaucuacuuuagaaccuguagaaaaagccuuacgugacgcaaaauuagauaaagcacaaauacaugacgucguauuaguagguggaaguacccgaauaccaaaaguacaaaaacuauuacaagauuucuuuaacggaaaagaacuaaacaaaucaauuaauccagaugaagcaguugcuuacggcgcagcaguacaggcagcaguauuaaugggagauaaaugugaaaaaguacaagauuuguuacuucuagacguggcaccccuaagccuaggauuagaaacagcaggaggaguaaugaccacauuaauacaaagaaaugcaacaauaccuacuaaacaaacacaaacauuuacaacauauagugacaaucaaccugggguauucauacaaguauaugaaggugaaagagcaaugacaaaagauaauaauuuacuagguagauuugaauuaucagggauuccaccagcaccacgaggaguaccgcaaauagaggugacuuuugacauagacgcaaauggcaucuuaagcguaacagcaacagauagaagcacaggaaaagcaaacaaaauaacaauaacaaaugacaaaggaagguuaagcaaagaggaggucgaaaggaugguacaugaagcagagcaauauaaggccgaagaugaagcccaaagagacagaguagcagcuaaaaauucacuagaagcacauguguuucacguaaaagggagcuuacaagaagagaguuuaagagauaaaauaccagaagaagauagacgaaaaaugcaagauaaaugcagagaaguauuagcauggcuagaacauaaucaacuggcagaaaaagaagaauaugaacaucaaaaacgagaauuagaacaaauaugcagaccaauauucucaaggcuauauggcggaccaggaguaccaggaggaaguucuuguggaacucaagcuagacaaggagacccuucuacaggaccaauaauugaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4968 - RNA, 1451 nt, Artificial Sequence
  mRNA product Design3 comprising derived and/or modified sequence from Homo sapiens__P48741__HsHSPA7 (opt13)
gggagagucccgcagucggcguccagcggcucugcuuguucgugugugugucguugcaggccuuauucaagcuuaccaugcaagcacccagagaauuagccguaggaauagaccuaggaacuacauauagcugugucggaguauuucaacaaggaagaguugaaauauuagcaaaugaccaaggaaauagaacaacaccuucauauguagcauucacagacacagaaagguuaguaggagaugccgcgaaaagccaagcagcauuaaacccacacaauacaguauucgaugcaaaaagacucaucggaagaaaauuugcagauacaacaguacaaucagauaugaaacauuggccauuucaaguagucucagaaggcggaaaaccaaaaguaagaguauguuacagaggagaagauaaaacauuuuauccagaagaaauaucaaguaugguauuaucaaagaugaaagaaacagcagaagcauaucuaggccaaccaguaaaacaugcaguaauaacaguaccaacuuauuucucaaauucacaaagacaagcaacaaaagaugcuggagcaauugcaggucuaaaaguauuaccaaucauaaaugaagcuacagcugcagcaauagcauauggccuagauagaagaggagcaggaaaaagaaauguauuaauauuugauuuaggaggaggaaccuuugacguaucaguauuaucaauagaugcaggaguauuugaaguaaaagcaacagccggagauacacaucuaggaggagaagauuucgacaacagauuaguuaaucacuucauggaagaauuuagaagaaaacacggaaaagacuuaucagguaauaaaagagcacuuagaagauuaagaacagcaugugaaagagccaaaagaacaccaucaagcucaacacaagcgacauuagaaaucgauucacuauucgaaggaguagauuuuuauaaaucaauaacuagagcccgauuugaagaauuauguucagacuuauuucgaagcacacuagaaccaguagaaaaagcacuaagagaugcaaaacuagacaaagcacaaauacacgacuucguauuaggaggaggacuacacagucauccacaaggagcugaaguagcugcaggauuauuacaaagacaaggagcagaacaagaacaccaaccuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4969 - RNA, 2288 nt, Artificial Sequence
  mRNA product Design3 comprising derived and/or modified sequence from Homo sapiens__NP_006588.1 __HsHSPA8 (opt13)
gggagagucccgcagucggcguccagcggcucugcuuguucgugugugugucguugcaggccuuauucaagcuuaccaugucaaaagguccugcuguaggaauugacuuaggaacgacauauucguguguuggugucuuccaacaugggaaaguagaaauuauagcaaacgaucaaggaaaccgaacaacaccaucauacguagcuuuuacagauacagaaagauuaaucggagacgcggcuaaaaaucaaguagcaaugaauccaacaaacacagucuuugacgcaaaacgacuaauaggaagaagauuugaugaugcaguaguucaaagcgauaugaaacacuggccauuuaugguaguaaaugacgcaggaaggccaaaaguacaaguagaauacaaaggagaaacaaagagcuucuauccggaagaaguaucaagcaugguauuaacaaaaaugaaagagauagcagaggcauacuuaggaaaaacaguaacaaacgcaguagucacaguuccagcauauuucaacgauagccaaagacaagcaacaaaagacgcagguacaauagcaggauuaaauguacuccggauaauaaacgaaccaacagcugcugcaaucgcguauggacuagauaagaaaguaggcgcagaaagaaauguauuaaucuucgacuuaggaggaggaacauucgauguaucuauucuaacaauagaagacggcauauucgaaguaaaaagcacagccggcgacacacacuuaggaggagaagauuucgauaaccgaaugguaaaccauuucauagccgaguucaaaaggaaacacaagaaagacauaagugaaaauaaaagagcaguacgccgauuaagaaccgcaugugaaagagcaaaaagaacucuaaguucaagcacacaagcgaguauagaaauagacaguuuauaugaagguauagauuuuuauacaucaauaacaagagcaagauucgaagaacuuaacgcagaccuauuuagaggaacacuagacccaguagaaaaagcacuaagagaugcaaaauuagacaaaagccaaauacaugauauaguauuggucggaggaucgacuagaaucccaaaaauacaaaaacuauuacaagacuucuuuaacggaaaagaacucaauaaaucgauuaauccagaugaagcagucgcauauggagcugcgguacaagccgcgauauuaagcggagacaaauccgaaaacguccaagaucuauuacucuuagacguaacaccucugucgcuaggaauugaaacagccggugggguaaugacaguacuaauaaaaagaaacaccacaauaccaacuaaacaaacacaaacauuuacuacauacucagauaaucaaccaggaguccuaauucaaguuuacgaaggggaacgugcaaugacaaaagacaauaauuuacucggaaaauuugaacuaacaggaauaccaccagcaccaagaggaguaccacaaauagaaguaacauuugauauagaugcaaauggaauacuaaacguaagugcgguagauaaaagcacagguaaagaaaacaaaauaacaauaacuaacgacaaaggcagauuaucaaaagaagauauagaaagaauggugcaagaagcagaaaaauauaaagcagaagacgaaaaacaaagagauaaaguaaguaguaaaaauucauuagaaucauacgcauuuaauaugaaagcaacgguagaagaugaaaaauugcaaggaaaaauaaacgaugaagauaagcagaaaauuuuagacaaauguaacgaaauuauaaauugguuagauaaaaaucaaacagcagagaaagaggaauuugaacaucaacaaaaagaauuggaaaaggucugcaauccuauaauaaccaaauuauaccaaucugcgggaggaaugccaggcggaaugccaggaggauucccagguggaggagcuccaccaagcggaggagcaagcaguggaccaacaauagaagaagucgauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4970 - RNA, 2387 nt, Artificial Sequence
  mRNA product Design3 comprising derived and/or modified sequence from Homo sapiens__NP_004125.3 __HsHSPA9 (opt13)
gggagagucccgcagucggcguccagcggcucugcuuguucgugugugugucguugcaggccuuauucaagcuuaccaugaucagugcaagcagagcugccgcagcaagauuaguaggagcggcagcaagcagaggaccaaccgcugcuagacaucaagauaguuggaauggauuaucacacgaagcauuuagacucguaaguagacgagacuaugcaagcgaggcaauaaaaggcgcaguaguagggaucgauuuagggacgacaaacucaugcguagcagucauggaaggaaaacaagcaaaaguacuagaaaaugcagaaggagcgagaacaacaccaucaguaguagcguuuacugcagauggagaaaggcuaguaggcaugcccgcuaaaagacaagcaguaacaaauccaaauaauacauuuuaugcaacaaaaagauuaauaggaagaagauaugaugacccagagguacagaaagacaucaaaaauguaccuuuuaaaauaguaagagcaaguaacggagacgcauggguagaagcacaugguaaacuauauaguccgucgcaaauaggagcauuuguucuuaugaaaaugaaagaaacggcagaaaauuaucuagggcauacagccaagaacgcaguaauaacaguacccgcauauuucaacgauucacagcgucaagcaacgaaagaugcgggacaaauuagugggcugaauguauuaagaguaauaaacgaacccacagcugcagcccuagcguauggacucgauaaaucagaagacaaaguaaucgcaguauaugauuuaggugggggaaccuuugacauuucaauauuagaaauacaaaaaggcguauuugaaguaaaaaguacaaauggagauacauucuuaggaggagaagacuucgaucaagcucuauuacgacauauagugaaagaguucaaaagagaaacaggaguugacuuaacaaaagauaacauggcacuacaaagaguaagagaagcagcugaaaaagcgaaaugcgaacuaaguaguaguguacaaacagacauaaacuuaccauacuuaacaauggacucaucagggccaaaacaucuuaacaugaaacugacuagagcacaauucgaaggaauagucaccgaucuaauacguaggaccauugcaccaugccagaaagcaaugcaggacgcagaaguaucgaaaagcgauauaggagaaguaauauuaguugggggaaugacaagaaugccuaaaguacaacaaacaguacaagauuuauuuggaagggcaccaucaaaagcaguaaacccagacgaagcaguggcgauaggagccgcaauacaaggaggaguacuagcaggagacguaacugauguuuuauuacuagauguaaccccacuaaguuugggaauagaaacauuaggaggaguauuuacaaaacuaauaaauagaaauaccacaauaccuacaaagaaaucucaaguauuuucaacagcagcagacggccaaacacaaguggaaauaaaaguaugucaaggcgaaagagaaauggcaggagacaauaaacuguuaggacaauuuacuuuaauagguauaccaccagcaccaaggggaguaccucaaauugaaguaacauucgacauagacgcaaauggaauaguccauguaucagcgaaagauaagggcacagggagggaacaacaaauaguaauacaaaguagcggaggacugaguaaagacgauauagaaaauauggucaaaaaugcugaaaaauaugcugaagaggauaggaggaagaaagaaaggguagaagcgguaaauauggcagaaggaauaauacaugacacagaaacaaaaauggaagaauuuaaagaucaauuaccagcggaugaauguaauaaacucaaagaagaaauaaguaaaaugagagaguuacuugcaagaaaagauucagaaacgggagaaaauauacgacaagcagcaaguucacuacaacaagcuagucuaaaauuauucgaaauggccuauaagaaaauggcaucggaacgagaaggaucaggaucaucugguacaggggaacaaaaagaagaucaaaaagaagaaaaacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4971 - RNA, 2375 nt, Artificial Sequence
  mRNA product Design3 comprising derived and/or modified sequence from Homo sapiens__NP_079291.2__HsHSPA12A (opt13)
gggagagucccgcagucggcguccagcggcucugcuuguucgugugugugucguugcaggccuuauucaagcuuaccauggcugauaaagaagccggaggaucugauggcccuagagaaaccgcaccaacuucagcauauagcagccccgccagaucauuaggagauacaggcauaacucccuuaucaccaucccauauaguaaacgauacagauaguaaugucuccgaacaacaaucauuuuugguuguuguagcagucgauuucgguacaacaagcuccggauacgcauauuccuucacaaaagaaccggaauguauacauguuaugagaagaugggaaggcggcgacccaggaguuaguaaccaaaagacuccaacuacaauccucuuaacaccggaaaggaaauuccauucauucggauaugccgcacgcgauuuuuaccacgauuuagacccaaacgaagcgaaacaaugguuauaucuagaaaaauuuaaaaugaaacuacauaccacaggagaccuuacuauggauacagaccuaacagcugcaaauggaaagaaaguaaaagcauuagaaaucuuugcauacgcguuacaauacuuuaaagaacaagccuuaaaagaauuaagcgaccaagcuggaucagaauuugaaaauuccgacguacgaugggucauaacgguaccugcaauauggaaacaaccagcaaaacaauucaugagacaagccgccuaucaagcuggacuagcgucaccagaaaacagcgaacaacuaauaauagcacuagaaccagaagcagcaucaaucuauuguagaaaacuaagauuacaucaaaugauagaacuaucaucaaaagcugcaguaaauggauauucaggaagugacaccguaggugcaggauuuacucaagccaaagaacacauaagaagaaauagacaaucuagaaccuuucuagucgaaaauguaauuggcgaaauauggucugaauuagaagaaggagacaaauaugucguaguugacuccgguggaggaacaguggaucucaccguccaucaaauacgacuaccagaaggacaucuuaaagaacucuacaaagcuacaggaggaccauauggcucauuaggcguagauuaugaauuugaaaaacugcuauacaaaaucuucggagaagacuuuauagaacaauuuaaaaucaaaagaccagcagcauggguagauuuaaugauagcauucgaaucaagaaaaagagcugcagcaccagaucgaacuaauccguuaaauauaacguuaccauucucauucauugacuacuauaaaaaguuuagaggucauaguguugaacaugcacuaagaaaaucgaauguagauuuuguaaaauggucaagucaaggcauguuaagaaugucaccagaugccaugaaugcauuauuuaaaccaacuauagauucaauaauagaacauuuaagagacuuauuccaaaaaccagaaguaucuacaguuaaauucuuauuccuaguagggggauuugcagaagcuccacuucuacaacaagcagugcaagcagcauucggcgaccaaugucgaauaauaauaccucaagacguaggccucacaauacuaaaaggagcgguauuauuuggauuagauccugcagucauaaaaguaagaagaucaccucuaacauacgguguaggaguacuaaacagguacguagaaggaaaacacccaccugaaaaacuuuuagucaaagacggaacuagauggugcacagauguauuugauaaauucauaucagcagaucaaucaguagcauuaggagaacugguaaaacgaucauacacuccugcuaaacccagccaauuaguaaucguaauaaauauauauucaagugaacaugauaaugucucauuuauaacagauccaggaguaaagaaaugcggaacauugagauuggaccucacaggaacaucaggaacagcuguaccagcaagacgagaaauucaaacacuaaugcaauuuggagauaccgaaauaaaagcaacugcaauagauauagccaccagcaaaaguguaaaagugggaaucgauuucuuaaauuauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4972 - RNA, 2408 nt, Artificial Sequence
  mRNA product Design3 comprising derived and/or modified sequence from Homo sapiens__NP_443202.3 __HsHSPA12B (opt13)
gggagagucccgcagucggcguccagcggcucugcuuguucgugugugugucguugcaggccuuauucaagcuuaccaugcuagcaguaccugaaaugggauuacaaggucuauauauagguagcucgccagaacgaucaccaguaccaaguccgccgggaucaccucgcacacaagaaagcuguggaauugcaccacuaaccccuucucaaucaccaaagccagaaguuagagcaccccaacaggcuucauuuucuguaguaguagcaauagacuuuggcaccacauccucaggcuaugccuucagcuuugcaucagacccagaagcgauacauaugaugaggaaaugggaaggaggagauccagggguagcacaucagaaaacaccuacuugcuuauuacuaacaccagaaggcgcauuucauaguuuuggauauacagcaagagacuauuaucaugaucuggauccugaagaagcgcgugauugguuauauuuugaaaaauuuaaaaugaaaauccauucagcaacagaucuaacuuuaaaaacacaauuagaagcugucaauggcaaaacaaugccagcauuagaaguauuugcccaugcacuaagauuuuuccgagaacaugcacuacaagaacuuagagaacaauccccaaguuuaccugagaaagauacaguaagauggguauuaacagugccggcaauauggaaacaaccugcuaaacaauucaugagggaagccgccuauuuagcaggauugguuucacgagaaaacgcagaacaacuauugauagcuuuagagccagaggcggcaaguguauauuguagaaaacuaagauuacaucaacuacuagauuuaucaggcagagcuccaggaggagguagauuaggagaaagacgauccauugauucuaguuuuagacaagcuagagaacaacuaagaagaagcagacauucaagaacauuccuuguagaaaguggaguaggagaauuaugggcagaaaugcaagcaggagauagauauguaguugcagacuguggaggaggaacuguagaccucacaguucaucaacuagaacaaccacaugguacccuaaaagaauuauauaaagcgaguggcggcccauacggagcaguaggcguagauuuagcauuugaacaauuacucugucgaauauuuggagaagauuucauagcuacuuuuaaaagacaaagaccagcugcauggguagaucuaacuauagcuuucgaagcaagaaaaagaacagccggaccucauagagcaggagcauuaaauauaucucuaccauuuaguuuuauagauuuuuacagaaaacaacggggacauaacguagaaacggcauuacgaagaucaagugucaacuucguaaaauggucaucacaagguauguuaagaauguccugugaagcaaugaaugaacuauuucaacccacuguaagcggaauaauacaacacauagaagcauuauuagcaagacccgaaguucaaggaguaaaauuacuauuucuaguaggaggguuugccgaaucggcaguucuacaacaugcaguacaagcugcguuaggcgcacgaggauuacgaguaguaguaccccacgauguugggcuuacaauucugaaaggagcuguauuauuuggacaggcaccaggaguagucagaguuagaagaagcccacuaacauaugggguaggaguacuuaacagauuuguaccaggcaggcauccuccagaaaaauuauuaguacgagacggaagacguugguguacagauguauucgaaagauucguugcagcugaacaaagcguugcauuaggagaagaaguaagacgaucauauugcccagcuagaccaggucaaagaagaguucuaauaaacuuauauuguugcgccgcagaagaugcaagguuuauuacugauccuggaguucgaaaauguggugcacuuagccuagaacuagaaccggccgauuguggacaagauacagccggagcaccaccagguagaagagaaauaagagcugcuaugcaauucggagacaccgaaauaaaagucacagcaguagaugucagcacaaauagaucagugcgagcuaguauagacuuucuaucaaauugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4973 - RNA, 1763 nt, Artificial Sequence
  mRNA product Design3 comprising derived and/or modified sequence from Homo sapiens__NP_008879.3__HsHSPA13 (opt13)
gggagagucccgcagucggcguccagcggcucugcuuguucgugugugugucguugcaggccuuauucaagcuuaccauggcacgagaaaugaccauauuaggaagcgccguauuaacauuauuacuagcgggauauuuagcacaacaauaucuaccccuacccacaccaaaaguaaucggaauagacuuaggaacaacauauuguaguguaggaguuuucuucccaggaaccggaaaagucaaaguaauaccagacgaaaacggacacauaucaauuccaucaaugguaucauuuacugauaacgacguauauguaggauacgaaucaguagaauuagccgauagcaauccacaaaacacuauauaugacgcaaaaagauucauaggcaaaauauuuacagcagaagaacuugaagcugaaauaggaagauaucccuuuaaaguacuaaauaaaaacggaaugguagaauucucaguuacaucaaaugaaacaauaacagucaguccagaauacguagguagcagauuacuacuaaaacuaaaagaaauggcagaagcauacuuaggaaugccaguagcaaaugccguaauaucuguaccagcagaauucgauuuaaaacaacgaaauucaacaauagaagcagcuaaucuagcaggacuaaaaauauuaagaguuauaaacgaacccacagcagcagcaauggccuauggauuacacaaagcugacguauuucauguacuaguaauagaucuagguggagguacauuagacguaagcuuacuaaauaaacaaggaggcauguuucuuacacgagcaaugucaggcaacaacaaauuaggaggucaagacuuuaaccaaagacuacuacaauaucucuacaaacaaauuuaccaaacuuauggauuuguuccuucaagaaaagaagaaauacaucgauuacgacaagcaguagagaugguaaaacuaaauuuaacacuacaucagagugcacaacuuuccgucuuauuaacaguugaagaacaagaucgaaaagaaccacacaguucagacaccgaacuuccaaaagauaaauuaagcucagcagaugaccauagaguuaacagcggcuuuggaagaggauuaucagacaaaaaaagcggagaaagccaagugcuguuugaaaccgaaauaagcagaaaauuauucgauacacuuaacgaagaccuauuccaaaaaauauuaguaccaauccaacaaguacuaaaagaaggucaucuagaaaaaacagaaauagaugagguaguauuaguaggaggaucaacacguauacccagaauaagacaaguaauacaggaauuuuucggaaaagauccaaauacaucaguagacccagauuuagcgguuguuacaggagucgcaauacaagcaggaauagauggcggaagcuggccauuacaaguauccgcacuagagaucccaaacaaacaucuacaaaaaaccaauuucaauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4974 - RNA, 1877 nt, Artificial Sequence
  mRNA product Design3 comprising derived and/or modified sequence from Homo sapiens__NP_057383.2__HsHSPA14 (opt13)
gggagagucccgcagucggcguccagcggcucugcuuguucgugugugugucguugcaggccuuauucaagcuuaccauggcagcaauaggaguacauuuaggauguacaagugcauguguagcaguauauaaagauggaagagcaggaguaguagccaaugaugcaggggauagaguaacaccagcgguaguagcuuauucagaaaaugaagaaauaguaggauuagcugcaaaacaaucaagaauaagaaauauuaguaacaccguaaugaaagugaaacaaauacuaggaagaucuucaucagauccccaagcacaaaaauauauagcagaaucaaaaugucuaguaauagaaaaaaauggcaaacuaagauaugaaauagauacaggcgaagaaacaaaauuuguaaacccugaagaugucgcuagacuaauauucucaaaaaugaaagaaacagcacauucaguacuaggaucagaugcaaaugacguaguaauaaccguaccauuugauuuuggagaaaaacaaaaaaaugcauuaggagaagcagcaagagcagcaggauuuaacguguuacgacuuauacaugaacccucagcagcauuauuagccuauggaauaggucaagacucaccaacaggcaaaucaaauauauuaguauuuaaauuaggaggaacuagucuaucacucucaguaauggaaguaaauucaggaauauacagaguuuuaucaacuaauacagaugauaauauuggaggagcacauuuuacagaaacauuagcucaauaccuugcaagugaauuucaaagaaguuuuaaacacgaugucagaggaaaugcaagagcaaugaugaaacuaacgaauucagcagaaguagcaaaacauucauuaucaacauuagggucugccaauuguuuccuagauagucuuuaugaagggcaagacuuugacuguaauguaagucgagcaagauuugaacuacuguguucaccccuguuuaacaagugcauagaagcaauaaggggauuacuagaucaaaauggcuucaccgcagaugacaucaauaaaguaguacuauguggaggaagcucaagaauaccaaaacuccaacaauuaauaaaagauuuauuucccgcuguagaacuacuaaauaguauacccccagaugaaguaauaccaauaggugccgcaauagaagcaggcauauuaauaggcaaagagaaucuacuaguggaagacagucuaaugauagaauguagugcaagagacauauuaguaaaagggguagaugaaaguggagcaagcagauuuacaguauuauuccccagcggaacaccucuaccagcaagaagacaacauacucuacaagcgccagguucaauaucaucaguuugccuagaacuauacgaaucagacgguaaaaacucagcaaaagaagaaacaaaauucgcucaaguaguacuacaagauuuggacaaaaaagagaauggacuaagagauauucuagccguauugacuaugaaaagagauggaucacuacacguaacauguacagaccaagaaacaggaaaaugugaagcaaucucuauagaaauagccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4975 - RNA, 2924 nt, Artificial Sequence
  mRNA product Design3 comprising derived and/or modified sequence from Homo sapiens__NP_006635.2 __HsHSPH1 (opt13)
gggagagucccgcagucggcguccagcggcucugcuuguucgugugugugucguugcaggccuuauucaagcuuaccaugaguguuguggggcuagacguagggagccaaaguugcuauauagcaguagccagagccggaggaauagaaacgauagcaaaugaauucucagauagaugcaccccaaguguaauaucauucggaucaaaaaacaggacgauaggaguggcagccaaaaaucaacagauaacgcacgcaaauaacacagucagcaacuuuaaaagauuucacggaagagcauuuaacgacccauuuauacaaaaagaaaaagagaaucuaaguuacgacuuagucccccuaaaaaauggaggagugggaauaaaaguaauguauaugggcgaagaacaccuuuuuucaguugaacaaauaacugcgaugcuauuaacaaaacuaaaagaaacagcagaaaacucauuaaaaaaaccaguaacagacugcguaauaucaguaccaucauucuuuacagacgcugaacgacgaaguguucuagacgcagcacagauaguagguuugaauugucuaagacugaugaacgacaugacagcaguagcguuaaacuacggaauauacaaacaggaccuaccaagcuuggacgagaaaccuagaauaguaguauucguagacauggggcacucugcauuccaaguuagugcaugcgcauucaauaaagguaaacucaaaguauuaggaacagcauuugacccauucuuaggaggcaaaaacuuugacgaaaaacuuguugaacauuucugcgcggaauucaaaacaaaauauaaauuggacgccaaaagcaaaauaagagcccuuuuacgacuauaccaagagugcgaaaaacuaaaaaaacuaaugaguaguaauucaacugaccuaccacucaauauugaguguuucaugaaugauaaagauguaaguggcaaaaugaacagaucucaauucgaagaauuaugcgccgaauugcuacagaaaauagagguaccacuauauagccuccuagaacaaacacaucuaaaaguagaagauguuagugcaguggaaauaguaggaggcgcuacaagaauaccugcaguuaaagaaagaaucgcuaaauucuucggaaaagauauauccacaacacuuaaugcagacgaagcaguagcucgcggcugcgcucuccaaugugccauucuaaguccagccuucaaagucagagaauucucuguaacugacgcaguuccguucccuauaucacuuauauggaaccacgacagugaagauacugaaggagugcaugaaguauucagcaggaaccaugccgcuccuuucagcaaaguauuaacuuucuuacgaaggggaccauucgaauuagaagcauuuuacucagauccacaaggaguaccauacccugaagcaaaaauaggccgauucguaguacaaaacgucagcgcacaaaaagauggagaaaaaucaagagucaaaguaaagguacguguaaauacccacgguauuuucacaauaucaacagcauccaugguagaaaaaguaccuacagaagaaaaugaaaugucaagcgaagcagauauggaaugcuuaaaucaaagaccaccagaaaacccagauacagacaaaaacguacaacaagauaacucagaagcaggaacacaaccacaaguacaaaccgaugcucaacaaaccucacaaucaccuccaagcccagaacuuacuucugaagaaaacaaaaucccagacgcagauaaagccaacgaaaaaaaagucgaccaaccaccagaagcuaaaaaaccaaaaauaaaaguaguaaacguagaacugcccauagaagcaaaccuaguauggcaacuaggaaaagauuuauuaaacauguacauagaaacugaaggcaaaaugaucaugcaagauaaacuagaaaaagaacgcaaugacgcaaaaaacgcaguagaagaauauguauaugaauuuagagacaaauuauguggaccauaugaaaaauucauaugcgaacaagaucaccaaaauuuccuacgacuacucacugaaacagaagacugguuauaugaagaaggagaagaccaagcaaaacaagcuuacguagacaaacuggaagaacuaaugaaaauagguacgccuguaaaaguacguuuccaagaagcagaagaaagaccgaaaauguuugaagaauuaggacagagacuccaacacuaugcaaaaauagcugcagacuuccgaaacaaagaugaaaaauauaaccacauagaugaaagcgaaaugaaaaaaguugaaaaaucagucaacgaaguaauggaauggaugaacaacguaaugaaugcacaagcaaaaaaaagucuagaccaagacccaguagucagggcgcaagagauaaaaacgaaaaucaaagaauuaaauaacacuugcgaacccgucguaacgcaaccaaaaccuaaaauagaaucaccaaaacuagagcgcacgccuaaugguccaaacauagacaaaaaagaagaggaccuagaagauaaaaauaacuuuggugcagaacccccccaucaaaacggagaaugcuauccaaacgaaaaaaauaguguaaauauggaucuagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4976 - RNA, 3347 nt, Artificial Sequence
  mRNA product Design3 comprising derived and/or modified sequence from Homo sapiens__NP_006380.1 __HsHYOU1 (opt13)
gggagagucccgcagucggcguccagcggcucugcuuguucgugugugugucguugcaggccuuauucaagcuuaccauggcugauaaaguaagaagacaaagacccagaaggagaguuuguugggcucuaguagcaguauuacuggcagauuuauuagccuuaucagauacccuugcaguaauguccguagaccuaggaagugaaaguaugaaaguagcaauaguuaaacccggaguaccaauggaaauaguccuuaacaaagaaucuagaaggaaaacuccaguuauaguaacacuaaaagaaaaugaacgauucuucggcgacagugcagcaucaauggccaucaaaaauccaaaagcaacauuaagauacuuucaacaucuucuuggcaaacaagcugauaauccucaugucgcauuauaucaagcaagauuccccgaacacgaacuaacuuuugacccacaacgucaaacuguacacuuucaaauaaguucacaacuacaauuuaguccagaagaaguacucggaaugguccugaauuauucaagaucauuagcagaagauuucgcagaacaaccuauaaaagacgcaguaauaaccguuccuguguucuuuaaccaagccgaaaggcgagcaguauuacaagcagcucgaauggcaggauuaaaagucuuacaauugauaaaugauaauacagcaacagcacuuaguuacgggguauuuagacgaaaagauaucaauacgacagcucaaaauauaauguuuuaugacaugggaaguggcucaacagucugcacaauaguaacauaucaaauggucaaaacaaaagaagccgggaugcaaccacaacugcaaauacgagguguaggauucgauagaaccuuagggggacuagaaauggaauuaagauuacgagaaagauuagcaggauuauuuaacgaacaaaggaaaggccaacgugcaaaggauguaagagaaaauccaagagcgauggcaaaacuccugagagaggcuaauaggcuaaaaacggugcuaagcgcaaaugcggaccauauggcacaaauagaaggguuaauggaugacguagacuuuaaagccaaaguaacacgcguagaguucgaagaauuaugugcugaucuauuugaaagaguaccggguccaguucaacaagcguuacaaucggcagaaaugucacuugaugaaauagaacaaguaauuuuaguagggggcgcuaccaggguuccuaggguacaagaaguccuauugaaagccguggggaaagaagaauuagguaagaauauaaacgcagaugaagcugcugcaaugggugcaguguaucaagcagcagcacuaagcaaggcauuuaaggugaaaccguucguuguaagggaugcuguagucuauccaauauuaguagaauuuacucgcgaaguagaagaagaaccaggaauacauuccuuaaaacauaauaaaagagucuuauucagcaggaugggacccuauccucagagaaaaguaauaaccuucaaccgauacagucaugacuucaauuuccacauaaacuauggagauuuaggauuucuugguccggaagacuuaagaguauuuggaagucaaaaucuaacaaccguaaaauuaaaaggcgugggagacucauuuaagaaguaucccgauuacgaaucaaaaggaauuaaggcacauuuuaacuuagacgagagcggagucuuaagccuggacagaguggaaucaguauucgaaacguugguugaagauucagcugaagaagaaaguacacuaacgaaauugggaaacaccauaaguucucuauucggaggaggcacaacuccagaugcaaaagaaaaugguacagauacuguccaagaagaagaagaaucaccagcagaaggauccaaggacgaaccaggagagcaaguugaacuuaaagaagaagcagaagcacccguugaagauggaucacaaccuccaccacccgaaccgaaaggagacgccacgccggaaggagaaaaagcaacugaaaaagaaaauggagauaaaucagaagcacaaaaaccaucugaaaaagccgaggcaggaccagaagguguagcucccgcuccggaaggugaaaagaaacaaaaaccagcacgaaaaagacgcauggucgaagaaauaggaguagaauuaguaguuuuagacuuaccugaucucccagaagacaaacucgcacaaucaguacaaaaacuacaagaucuaacauugagagaucuggagaaacaagaaagagaaaaagcagcuaauagucuagaggcuuucauuuucgaaacccaagacaaauuauaccaaccugaauaccaggaaguuuccacagaagaacaaagggaagaaaucagugguaaauugagcgcagcuaguacaugguuagaagaugaaggaguuggagcaacgacaguaauguuaaaagaaaaauuagcagaauuaaggaaauuaugucaaggacucuucuuuagagucgaagaaagaaagaaauggcccgagagauugucagcauuagacaauuuauuaaaccauuccagcauguucuuaaaaggugccagacuuauaccagaaauggaucagauauuuacagaaguggaaaugacuacacuagaaaaaguaauuaacgaaaccugggcauggaaaaaugcaacacuagcagaacaagccaaauuaccggcgacggagaaaccaguacuauuaucgaaagauauagaagcaaaaaugauggcucuagaccgagaaguccaauaccuuuuaaacaaagccaaauuuacaaaaccaaggccaagaccuaaagacaaaaauggaacaagagcggaaccaccacuaaacgcgagcgcaagugaccaaggugaaaaaguaauuccaccagcuggacaaacagaagacgcugaacccauaagugaaccagaaaaaguagaaacaggaucagaacccggagauacugaaccacuagaguugggaggaccaggggcugagcccgaacaaaaagaacaaucaacaggccagaaaagaccgcucaaaaacgaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4977 - RNA, 2546 nt, Artificial Sequence
  mRNA product Design3 comprising derived and/or modified sequence from Homo sapiens__NP_005339.3 __HsHSP90AA1 (opt13)
gggagagucccgcagucggcguccagcggcucugcuuguucgugugugugucguugcaggccuuauucaagcuuaccaugccagaagaaacgcaaacacaggaccaaccaauggaagaagaagaaguugaaacauuugccuuccaagcugaaaucgcucaacuaaugucccucauaauaaacacauuuuacaguaauaaggaaauauuccuacgagaauuaauaucaaauaguagugacgcauuagauaaaauacguuacgaaagccuaacagauccgaguaaacuagacucaggaaaagaacuacacauaaacuuaauaccaaacaaacaagaccgaacacucacaauaguagacacagguauaggcaugacgaaagccgauuuaauaaacaaccucggaaccauugcaaaaagcggaaccaaggcauucauggaagcucuacaagcaggagcggacaucagcaugauaggccaguucggaguggguuucuauucagcauaccucguagcagaaaaaguaaccgucauaacgaagcacaacgacgaugaacaauaugcaugggaaucauccgccggaggaaguuucacaguccgaacugacacaggugaacccaugggaagagguacuaaaguaauccuucaucugaaagaagaucaaaccgaauaccucgaagaacgacgaauaaaagaaauuguaaaaaagcauucacaauucaucggauacccuauaacacucuucguagaaaaagaaagggauaaagaaguaagcgaugaugaagcagaagaaaaggaagacaaagaagaagaaaaagaaaaagaagaaaaagaaucagaagauaaaccagaaauagaagacguaggauccgacgaagaagaagaaaaaaaagacggugacaaaaaaaaaaaaaaaaagauaaaagaaaaauacauagaccaagaagaauuaaauaaaaccaaaccgauauggacgagaaaucccgacgacauaaccaacgaagaauacggagaauucuauaaaagccugaccaacgacugggaagaccaucuggcagucaaacacuucaguguagaaggacaauuagaauucagagcacuacuauuuguaccgagacgagcaccauucgacuuauucgaaaauagaaaaaaaaaaaacaacauaaaauuguacguaagaagggucuucauaauggacaauugugaagaacuaauacccgaauaucuaaacuucauuagaggcguuguagacucagaagaccuuccacucaauauaucaagagaaauguuacaacaaaguaaaauacugaagguaauaaggaaaaauuuaguaaaaaaaugcuuggaacuauucacagaacuagcagaagacaaagaaaacuacaaaaaauuuuaugaacaauucucaaaaaacauaaaguuaggaauucacgaagauagccaaaauagaaagaaacuaucugaauuguuacgauauuauacauccgcaucaggugacgaaauggugucguuaaaagauuacugcacacgaaugaaagaaaaccaaaaacauauauauuacauaacaggagaaacaaaagaucaaguagcaaacagcgcauucgucgaacgacugagaaagcacggauuagaaguaauauacaugauagaaccaauagaugaauauuguguacaacaauuaaaagaauucgaaggaaaaacucucguaucaguaacaaaggaaggacuugaacuaccagaagaugaagaagaaaaaaaaaaacaagaagaaaaaaagacaaaauuugaaaaccucugcaaaauaaugaaagacauacuggaaaaaaaaguagaaaaaguaguagucucaaacagacuagugaccucaccuuguuguauagucacaagcacauauggauggaccgcaaacauggaaagaauaaugaaagcacaagcauuaagagauaacucaacaauggguuacauggcagcuaaaaaacaucucgaaauaaauccagaucauucuauaauagaaacucuuagacaaaaagcagaagcagauaaaaacgacaagaguguaaaagacuuagucauacuauuauacgaaacggcacuacucagcaguggauuuaguuuagaagauccacaaacacacgcgaacaggaucuacagaaugauuaaacuaggauuaggaaucgaugaagaugacccaacagcagacgacacaucagcagcaguaacagaagaaaugccaccacuagaaggggacgaugacacuagccgaauggaagaaguagacuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4978 - RNA, 686 nt, Artificial Sequence
  mRNA product Design3 comprising derived and/or modified sequence from Homo sapiens__NG_005218__HsHSP90AA3P (opt13)
gggagagucccgcagucggcguccagcggcucugcuuguucgugugugugucguugcaggccuuauucaagcuuaccauggacagcucaaaacuagacucaggaaaaggacuacacauaaaccuaguaccaaacaaacaaaaccaaacacuaacaauaguagacacaagaauaggaaugacaaaaacagaccuaauaaacaaccuaggaacaguaacaaaaagcggaacaaaagcauucauggaagcacuacaagcagacgcagacauaagcaugauaggacacuucggaguaggauucuacucagcauaccuaguagcaaaaaaaguaacaguaauaucaaaacacaacaacgacgaacaauacacaugggaaucaagcgcaggaggaagcuucacaguaagaacagacgaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4979 - RNA, 2522 nt, Artificial Sequence
  mRNA product Design3 comprising derived and/or modified sequence from Homo sapiens__NP_031381.2__HsHSP90AB1 (opt13)
gggagagucccgcagucggcguccagcggcucugcuuguucgugugugugucguugcaggccuuauucaagcuuaccaugccagaagaaguacaucauggagaagaagaagucgaaacguuugcuuuccaagcggaaauagcgcaacuaaugagccuaauaauaaacacauucuauaguaacaaagaaaucuucuugagggaauuaauuucaaacgccuccgaugcauuagacaaaauaagauacgaaagcuuaacagacccaucaaaauuagauagcggaaaagagcuaaaaaucgacauaauaccuaacccacaagaacguacacugacacuuguagauacaggaauaggaaugacaaaagcagaccuaauaaacaaccuaggaacuauagcuaaaucaggcacgaaagccuucauggaagccuuacaagcaggagcagauauaucaaugauaggacaauuuggagugggauucuacagcgcauaccuaguagcagaaaaaguagucguaauaaccaaacauaaugacgacgaacaauacgcaugggaaagcucggcaggaggcagcuuuacaguaagagcagaucauggcgaaccuauaggaaggggcaccaaagucauccuacaucucaaagaagaucaaacagaauauuuagaagaaagacgagugaaagagguagucaaaaagcauucccaauuuauaggcuauccaauaaccuuauaccuagaaaaagaaagagaaaaagaaauaucagacgacgaagccgaagaagaaaaaggagaaaaagaagaagaagauaaagacgaugaagaaaaaccaaaaauagaagauguaggaagcgaugaagaagacgacucaggaaaagacaaaaaaaaaaagacaaaaaaaauaaaagaaaaauauaucgaucaagaagaacucaacaaaacaaaacccauauggacaagaaauccagacgacauaacacaggaagaauacggagaauucuauaaaagccuuacgaaugacugggaagaucaucuagcaguaaaacacuucucuguagaaggacaacuagaauuccgagcccuacuauucauaccaagacgcgcaccauucgaccuauucgaaaauaaaaaaaaaaaaaacaauauaaaauuauauguacggagaguguucauaauggacaguugcgaugaacuaauaccagaauacuuaaacuuuauaagaggagugguagacucagaagaccuaccccuaaauauaagccgggagauguuacaacaaagcaaaauauuaaaaguaaucaggaagaacauuguaaaaaaaugucuggaacuauuuucagaguuagcagaagauaaagaaaacuacaaaaaauucuacgaagcauucucaaaaaauuuaaaauuagggauacaugaagacagcacaaacagaagaagacugagcgaacuacuaagauaucauacaagucaaaguggagacgaaaugacuucacuaagugaauacguaucaagaaugaaagaaacacaaaaaucuauuuacuacauaacuggagaaucaaaagaacagguagcaaacagcgcauuugucgaacgaguaagaaaacgaggauucgaaguaguuuauaugacagaaccuaucgaugaauauugcguccaacaacuaaaagaauuugacggaaaaucacuugucaguguaacaaaagaaggacuagaacugcccgaagacgaagaagaaaaaaaaaaaauggaagaaucaaaggcuaaauucgaaaaucuaugcaaauuaaugaaagaaauacucgacaaaaaaguagaaaaaguaaccauaagcaaucgacuaguaucaaguccuugcuguauagucacaucaacauauggauggacagcgaauauggaaaggauaaugaaagcccaagcacuuagagacaauaguacaaugggauacaugauggccaaaaagcaucuagaaauaaauccugaccacccaaucguagaaacacuaagacaaaaagcagaagcagauaaaaacgacaaagcaguuaaagacuuaguugucuuauuauucgaaacagcacuacucucaaguggauucucacuagaagacccccaaacacauaguaacagaauauaccgaaugauuaaauugggauuaggaaucgacgaagacgaaguggcagccgaagaaccaaaugccgcaguacccgaugaaauaccaccccuagaaggagacgaagacgcaaguagaauggaagaaguagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4980 - RNA, 2759 nt, Artificial Sequence
  mRNA product Design3 comprising derived and/or modified sequence from Homo sapiens__NP_003290.1__HsHSP90B1 (opt13)
gggagagucccgcagucggcguccagcggcucugcuuguucgugugugugucguugcaggccuuauucaagcuuaccaugagggcauuauggguucuaggacuauguugcguacuacuaacguucggaucaguaagagcagacgaugaaguagaugucgauggcacaguagaggaagaccuaggaaaaucaagagaaggaagccguacagacgacgaaguagugcaaagagaagaggaagcaauccaguuggauggacuaaaugcaagucaaauaagagaacuaagagaaaaaucagaaaaauucgcauuucaagcagaagugaacagaaugaugaaacuaauaaucaauucauuauauaaaaacaaagaaauauuccugagagaacuaauaagcaacgcaagugaugcuuuagauaaaauacgacuaauuagcuuaacagacgaaaaugcauuaagcggaaaugaagaguuaacaguaaaaauaaaaugugacaaagaaaaaaacuuacuccaugugacagacacaggaguaggaaugacccgcgaggaauugguaaaaaaucuaggaacgauagcuaaaagcggaacaagugaauuucuuaauaaaaugacagaagcacaagaagacggccaaucaacaagugaacuaauaggacaauucggaguugguuuuuauagugcuuuuuuaguugcugacaaaguaauagucacgucgaaacauaauaacgacacacaacacaucugggaaagugacucgaaugaauuuucaguuauagcagauccaagaggaaauacgcuaggcagagggacaacaauaacauuaguacuuaaagaagaagcaucagauuauuuagaauuagauacaauaaaaaaccuaguaaaaaaauauagucaauucauaaauuuccccauauauguauggaguaguaaaacagaaacgguagaagaaccaauggaagaagaagaagcagcuaaagaagaaaaagaggaaagugacgaugaagcagcaguugaagaagaagaagaagaaaaaaagccgaaaacuaaaaaagucgaaaaaacgguaugggacugggaacuuaugaacgauauaaagcccauauggcagagaccgagcaaagaaguagaagaagaugaauauaaagcauuuuacaaaucauuuaguaaagaaucagacgauccaauggcuuacauacauuuuacagccgagggagaaguaacauucaaaucaauuuuguuuguaccaacaagugcucccagagggcuauucgaugaauacggaucaaaaaaaagcgacuauauaaaacucuauguaagaagaguauucaucaccgacgacuuccacgauaugaugccuaaauaccuaaauuucguaaaaggagucguagauagugaugacuuaccauuaaauguaagcagagaaacucuccaacaacauaaauuacuaaaagugauacguaaaaaauuaguaagaaaaacacucgacaugauaaaaaaaauagcggaugauaaauauaaugauacauucuggaaagaauucggaacaaauauaaaacuuggcguaauagaagaucacucuaauagaacaagacuagcaaaacucuuaagguuccaaagcucacaucacccaaccgauauaacuucauuagaucaauauguagaaaggaugaaagaaaaacaagauaaaauauauuuuauggcaggaucaucaagaaaagaagcugaaaguagcccauucgucgaaagacuucuuaaaaaaggguaugaaguuauauauuugacagaaccaguagaugaauauuguauacaggcacuaccagaauucgaugguaaaagauuccaaaacguagcaaaagaaggcguaaaauucgacgaaagugagaaaacuaaggaaucacgagaagcgguagaaaaagaauucgagcccuuacucaauuggaugaaagacaaagcacuaaaagauaaaaucgaaaaagcuguggucagucaaagauuaacagaaucaccaugcgcauuaguugcaagucaauauggguggucaggaaauauggaaagaauaaugaaagcgcaagcauaucaaacuggaaaggauauaucgacuaacuacuacgcaucgcaaaagaaaacauucgaaauaaauccuagacacccauuaauaagagacaugcuacgaagaaucaaagaagaugaagacgacaagacaguacuagaucuagcaguaguauuauuugaaacagcaacauuaagaucggguuaccuucuuccggauacaaaagcauacggcgacagaauagaaagaaugcucagacuaucacucaacaucgacccagaugcaaaaguggaagaggaaccagaagaagaaccagaagaaacagcagaagauacgacagaagacacugaacaagaugaggacgaagaaauggacgugggaacugacgaagaagaagaaacugcaaaagaaagcacugcugagaaagaugaacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4981 - RNA, 2462 nt, Artificial Sequence
  mRNA product Design3 comprising derived and/or modified sequence from Homo sapiens__NP_057376.2__HsTRAP1 (opt13)
gggagagucccgcagucggcguccagcggcucugcuuguucgugugugugucguugcaggccuuauucaagcuuaccauggcaagagaacuaagagcucuauuacucuggggaagaagacuacgaccauuauuaagagccccugcauuagcagcugucccaggcgguaaaccuauccuauguccaagaaggacgacagcgcaauuaggaccuagaagaaauccagcuuggagcuuacaagcagguagauuauuuaguacacaaacagcagaagauaaagaagaaccucuacauagcauaaucaguaguacagaaucuguacaaggaaguacaaguaaacacgaauuucaagccgaaacaaagaaacuccuugacaucguagcuagaagucuauauucagaaaaagaaguauucaucagggaauuaauuucaaaugcaucagaugccuuagaaaaacuaagacacaaacugguauccgauggacaagcccuaccagaaauggagauacauuuacaaacaaacgcagaaaaagguaccaucacaauccaggauacagguauaggcaugacucaagaagaacuuguuucuaaccuaggaacuauagcaagaucuggcaguaaagcauuccuagaugcuuuacaaaaccaagcagaagcaucuucaaaaauaauaggacaauuugguguaggauucuauagugcauuuaugguggcugaucguguagaaguuuauucacggucagcagcuccaggaucauuaggauaccaauggcuaucugaugguucaggagucuucgagauugcagaagcauccggaguaagaacaggcacaaaaaucauaauacaccuaaaaucugauugcaaagaauuuucuagcgaagcaagaguaagagauguagucacaaaauacuccaacuucgucucauucccacuauacuuaaauggcagacgaaugaauacucuacaagcuauauggaugauggauccaaaagauguccgggaauggcaacaugaagaguucuauagauacguugcucaagcucacgacaaaccacgauauacacuucauuacaaaaccgaugcaccacuuaauauaagaucaauauuuuauguaccagacaugaaaccaucuauguucgauguauccagagaauuaggaucaucuguagcauuauacucaagaaaaguguuaauacaaacuaaagcaacagauaucuuaccaaaauggcuucgauucauaagaggaguuguagauucagaagacaucccacuaaacuuaucgagagaauuacuacaagaaucagcacuuauuagaaaacuaagagauguccuacaacaaagauuaauaaaauucuuuauagaucaaucaaagaaagaugcagaaaaauacgcaaaauucuucgaagacuauggacuauuuaugagggaaggcauaguaacugcaacagaacaagaaguuaaagaagacauugcaaaacuacuaagauaugaaaguuccgcguuaccuucaggccaacucacgagucuaagcgaauaugcaagccgcaugcgugcaggaacuagaaacauauacuaccuaugugcgccuaacaggcaucucgcagaacauuccccuuacuacgaagcaaugaaaaagaaagauacagaaguacucuucugcuucgaacaauuugaugaacucacauuauuacaucuacgcgaguucgacaaaaagaaauuaauauccguagaaacagacaucgucguagaccacuauaaagaagaaaaauuugaagacagaucccccgcagcagaauguuuaagugaaaaagaaacagaagaauuaauggcauggaugagaaacguacuuggcucaagaguuacuaacguuaaaguaacucuacgacuagacacacauccugccaugguaacggucuuagaaaugggagcagcaagacacuuccuuagaaugcaacaauuagcaaaaacccaagaagaaagagcacaauuacuacaaccaacauuagaaaucaauccuaggcaugcauuaauaaagaaacuaaaccagcuuagagcaagcgaacccggucuugcacaacuauuaguagaucaaaucuaugaaaacgccaugauagcagcaggucuaguugacgaccccagagcaaugguagguagacuuaacgaacuacucgucaaagcauuagaaaggcauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4982 - RNA, 809 nt, Artificial Sequence
  mRNA product Design3 comprising derived and/or modified sequence from Homo sapiens__NP_000609.1__HsIGF1 (opt13)
gggagagucccgcagucggcguccagcggcucugcuuguucgugugugugucguugcaggccuuauucaagcuuaccaugggaaaaauaucaucacuaccuacacaacuauucaaaugcugcuucugcgacuuccuaaaaguaaaaaugcacacaaugucauccucacaccuauucuaccuagcacuaugccuacuaacauucacaucaucagcaacagccggaccagaaacacuaugcggagcagaacuaguagacgcauuacaauucguaugcggagacagaggauucuacuucaacaaaccaacaggauacggaucaucaucaagaagagcaccacaaacaggaauaguagacgaaugcuguuucagaucaugcgacuuaagaagacuagaaauguacugcgcaccauuaaaaccagcaaaaagcgcaagaucaguaagagcacaaagacauacagacaugccaaaaacacaaaaagaaguacaccuaaaaaacgcaucaagaggaucagcaggaaacaaaaacuacagaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4983 - RNA, 890 nt, Artificial Sequence
  mRNA product Design3 comprising derived and/or modified sequence from Homo sapiens__NP_000603.1__HsIGF2 (opt13)
gggagagucccgcagucggcguccagcggcucugcuuguucgugugugugucguugcaggccuuauucaagcuuaccaugggaauaccaaugggaaaaucaaugcuaguacuauuaacauuucuagccuucgcaucauguugcauagcagcauacagaccaagugaaacucuauguggaggagaauuaguagauacacuacaauuuguauguggagauagagguuucuauuucaguagaccagcaagcagaguaucaagaagaaguagaggaauaguagaagaaugcuguuucagaucaugugaccuagcacuacuagaaacauauugcgcaacaccagcaaaaucagaaagagauguaucaacaccaccaacaguauuaccagauaacuuuccaagauacccuguaggaaaauuuuuccaauacgauacauggaaacaaucaacacaaagacuaagaagaggacuaccagcacuacuaagagcaagaagaggacacguacuagcaaaagaacuagaagcauuuagagaagcaaaaagacauagaccauuaauagcauuaccaacacaagauccagcacacggaggagcaccaccagaaauggcaucaaacagaaaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4984 - RNA, 986 nt, Artificial Sequence
  mRNA product Design3 comprising derived and/or modified sequence from Homo sapiens__NP_000591.1__HsIL6 (opt13)
gggagagucccgcagucggcguccagcggcucugcuuguucgugugugugucguugcaggccuuauucaagcuuaccaugaacucauuuucaacaucagcauucggaccaguagcauucucacuaggauuacuacuaguacuaccagcagcauucccagccccaguaccacccggagaagacuccaaagacguagccgccccacacagacaaccacuaacaucauccgaaagaauagauaaacaaauaagauacauacuagacggaaucucagcacuaagaaaagaaacaugcaacaaaucaaacaugugcgaaucaucaaaagaagcacuagcagaaaacaauuuaaaccuaccaaaaauggcagaaaaagacggcugcuuccaaucaggauucaaugaagaaaccugccuaguaaaaauaauaacaggauuacucgaauucgaaguauacuuagaauaccuacaaaacagauucgaaucaucagaagaacaagcaagagcaguacaaaugagcacaaaaguacucauacaauuccuacaaaaaaaagcaaaaaaucuagacgcaauaacaacaccagacccaacaacaaacgcaucacuacuaacaaaacuacaagcacaaaaccaauggcuacaagacaugacaacucaccuaauacucagauccuucaaagaauuucuacaauccucacuaagagcacuaagacaaauguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4985 - RNA, 1628 nt, Artificial Sequence
  mRNA product Design3 comprising derived and/or modified sequence from Homo sapiens__NP_002183.1__HsINHBA (opt13)
gggagagucccgcagucggcguccagcggcucugcuuguucgugugugugucguugcaggccuuauucaagcuuaccaugccauuacuaugguuaagagguuuucuauuagcaucaugcuggauaauaguaagaucaaguccaacaccaggaagugaaggucauagugcagcaccugacuguccuaguugcgcauuagcagcauuaccaaaagacguaccaaacagccagccagaaaugguagaagcaguaaaaaaacauauauuaaauaugcuacaucuaaaaaaaaggccagacguaacacaaccaguaccaaaagcggcuuuauuaaaugcaauaagaaaauuacauguagguaaaguaggagaaaacgguuacguagaaauagaggaugacauaggccgaagagcagaaaugaaugaacuaauggaacaaacaagugaaauaauaacauuugcagaaucaggaacagcaagaaaaacgcuacacuucgaaauaagcaaagaaggaagcgaucuuagugugguagaaagagcagaaguaugguuauuccugaagguacccaaagccaaucgaacgagaacaaaaguaacaauaagauuauuucaacaacaaaaacauccacaagguucacuagauacaggagaggaagccgaagaaguagguuuaaaaggagaaagaucugaauuauuauuguccgaaaaaguaguagaugccagaaaaaguaccuggcauguauuuccagugaguucaucaauacaaagauuacuagaucaagguaaaucaucacuagauguaagaauagcaugugaacaaugucaagaaaguggagcuaguuuaguacuauuaggaaagaaaaaaaaaaaggaggaagaaggagaaggaaaaaaaaaaggaggaggagaaggaggagcgggagcagaugaagaaaaagaacaaagucauagaccauucuuaauguuacaagcaagacaaagcgaagaucauccacacagaagaagacgacgaggacuagaaugcgauggaaaagucaauauauguuguaaaaaacaauuuuuuguaucauuuaaagacauaggauggaacgauuggauaauagcgccaucaggauaucacgcuaacuauugugaaggagaauguccaagccauauagcaggaacgaguggaagcucauuaucauuucacagcacgguaauaaaccauuauagaaugagaggacauagcccauuugcaaauuuaaaaucauguuguguaccuacaaaacuacguccaaugagcaugcuauauuacgacgacggacaaaauauuauaaagaaagauauccaaaauaugauaguagaagagugcggauguagcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4986 - RNA, 1571 nt, Artificial Sequence
  mRNA product Design3 comprising derived and/or modified sequence from Homo sapiens__NP_002184.2__HsINHBB (opt13)
gggagagucccgcagucggcguccagcggcucugcuuguucgugugugugucguugcaggccuuauucaagcuuaccauggauggauuaccagggagagcauuaggagcagcaugucuauuauuauuagcagcagguugguuaggcccagaagcauggggaucuccaacaccaccaccaacaccagcagcacccccaccaccaccaccaccaggaaguccaggaggaagccaagauacauguacaagcugugguggauuuagaagaccagaagaauuaggaagaguagauggagacuuuuuagaagccguaaaaagacacauacuuucaagauuacaaaugagaggaaggccaaauauaacacaugcaguaccaaaggcagcaaugguuacagcauuaagaaaauuacacgcaggaaaaguaagagaagaugguagaguagaaauaccacauuuagacgggcacgcaucaccaggugcagaugggcaagaaagaguaagugagauaauuagcuuugcagaaacagauggauuagcaucaucaagaguacgauuauauuucuuuauaaguaacgaaggaaaucaaaaucuauucguagugcaagcaucacuaugguuauauuuaaaauuauugccauauguacuagaaaaaggaagcagaagaaagguaagaguuaaaguuuauuuucaagaacaaggucauggagaucgauggaauaugguagaaaaacgaguagauuuaaaaagaucaggauggcauacauuuccacuaacagaagcaauacaagcauuauucgaaagaggcgaaagaagacugaauuuagacgugcaaugugacucaugccaagaauuagcagugguuccagucuuuguagacccaggagaagaaagccauagaccauuuguaguaguacaagcaagacuaggagauaguagacauagaauaagaaaaagagguuuagaaugugacggaagaacaaauuuauguugcagacaacaauucuuuauugauuuuagguuaauagguuggaaugauuggauaauagcaccaacaggauauuauggaaauuauugugaaggaagcuguccagcauauuuagcugguguaccagguucagcuaguaguuuucacacagcaguagucaaucaauaucguaugcgaggauuaaauccugguacuguaaauagcuguuguauaccaacaaaacuaaguacaaugucaauguuauauuuugaugaugaauauaauauaguuaaaagagauguuccaaauaugauaguagaagaauguggaugcgcuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4987 - RNA, 3806 nt, Artificial Sequence
  mRNA product Design3 comprising derived and/or modified sequence from Homo sapiens__NP_000623.2__HsITGAM (opt13)
gggagagucccgcagucggcguccagcggcucugcuuguucgugugugugucguugcaggccuuauucaagcuuaccauggcauuacgagucuuacuuuuaacagcauuaacucugugccacggauuuaaucuugauacagaaaaugcaaugacauuucaagaaaacgcacgaggauuuggccagucgguaguacaguuacaggguagcaggguuguugucggugccccacaagaaauaguagcagccaaucaaagagguucacuauaccaaugugauuacucuacaggaaguugugagcccauaagauuacaaguacccgucgaagcagucaauaugucccuaggacuaaguuuagcagcaacaacuagcccaccacaauuacuagcuugcggcccaaccguacaccagacauguucugaaaauaccuaugucaaagguuuaugcuucuuauucgguaguaauuuaagacagcaaccacaaaaauuuccugaagcacuacgcggauguccucaagaagacuccgacauagcauuucuaauagacggaaguggcaguauaauaccccaugacuuuaggagaaugaaagaauuuguguccacaguaauggaacaacuaaagaaaucuaagacacuuuucucauuaaugcaauauagugaagaauuuagaauacauuucaccuucaaagaauuucaaaacaacccgaauccaagaucccuaguuaaaccaauaacccaguuacuaggaagaacacauacugccacaggcauucgaaaaguaguacgagaacuauuuaacauuacuaauggagcuagaaagaacgcuuucaaaauucuaguaguuauaacugauggagagaaauucggagacccucuuggauacgaagauguuauaccagaagccgauagagaaggagucauaagauauguaauaggaguaggcgaugccuuccgaagcgaaaaauccagacaggaacuaaauacaauagcuagcaaaccaccgagggaccacguuuuucaagucaauaauuuugaagcauuaaaaaccauucaaaaccaacuaagggagaaaauauucgcuauagaaggaacacaaaccggaucuaguaguagcuuugaacaugaaaugucccaagaagguuuuucugcugcgauaacuucaaauggcccacuacuaucaacagucgguaguuaugauugggccggaggaguauuccuuuauacaaguaaagaaaaaucaacauucauaaauaugacaagaguagacucugauaugaaugaugccuauuuaggauacgcagcagcaaucauacuacgcaacagaguccaaucacucguacuaggugcccccagauaccaacauaucggucuggucgcuauguuucgucaaaauacagguaugugggaaaguaaugcaaauguaaaagguacucaaauaggcgcauauuuuggugcuucauuaugcagcguugacguggauucgaacgguaguacagacuuaguguuaauaggcgcaccccacuacuacgaacaaacaagaggugggcagguaucaguaugcccucuacccagaggccgugccagauggcaaugugacgcaguacuauauggagaacaagggcaaccaugggguagauuuggggcugcauugacaguuuuaggagacguaaauggagauaaacuaacggauguugcuauaggagccccuggugaggaagauaauagaggagcgguauaccuauuucauggaacaucuggaaguggaauuucaccuagucacucacaaaggauagcaggauccaagcucuccccacgauuacaauauuuuggacagagccuaucgggaggucaagaucuaacuauggaugguuugguggaucucaccguaggcgcucaaggucaugugcuacuauuacgaucacaaccuguacuuagaguaaaagccauaauggaguucaacccaagagaaguagcucguaauguauucgaaugcaacgaucaaguuguaaaaggcaaagaagcaggagaagugcgugucugucuucauguucagaaaagcacacgugaucgauuaagagagggccaaauucaaucuguaguuacauacgacuuagccuuagacuccggacgaccacacucucgcgcagucuuuaaugaaacgaaaaacucaacacgaaggcaaacacaaguacuaggauuaacucaaacaugcgaaacccuuaaacuacaauuaccuaacuguaucgaagacccaguaucuccaaucguauugagacuaaauuuuuccuuaguaggcacaccacuuagugcuuuuggaaaucuaagaccggucuuagcagaagaugcucaaagauuauuuaccgcacuguucccauucgagaaaaacuguggaaacgauaauauaugccaagacgacuuaucuauuacauucucauucaugucguuagauugucuaguaguaggaggacccagagaauuuaauguaaccgucacaguucgaaaugacggagaagacucauauagaacccaaguaacauucuucuuuccguuagaucucagcuaucggaaaguaucaacauuacaaaaccaacgaagccaacgaucauggaggcucgcaugugaaagcgcuuccaguacggaaguaaguggagcacucaaaucuacaucuugcucuauuaaccacccaauauuuccggaaaacagugaggucacuuuuaauaucaccuucgacguagauagcaaagccaguuuaggaaauaaacuucuucucaaggcaaacguaacuucugaaaauaauaugccaagaaccaacaaaacagaguuccaacuagaauuaccagucaaauacgcaguauauaugguaguaacaagucauggaguuuccacgaaauaccuaaacuuuacugcaucagaaaacacaagcagaguaaugcaacaucaauaccaaguaucaaauuuaggacaacgaaguuuaccaauaucguuaguuuuccuggucccagucagauugaaucaaacaguaaucugggauagaccacaaguaacauuuucagaaaaucucucaucaaccugucauaccaaggaaagauuaccuucacauucagauuuucuagcagaacuacgcaaagcuccaguaguuaauugcucaaucgcaguaugucaaagaauacaaugugacaucccauucuuuggcauucaagaagaauuuaacgcuacauuaaaaggaaaucuuaguuuugauugguacaucaaaaccagucauaaccauuuacuaauagucucuacugcugaaauacuauuuaaugauucuguauuuacucuauuaccaggacaaggagcuuuuguucgaucacaaacagaaacuaaaguagaaccauucgaagucccaaauccauuaccauuaaucguggguucuucuguaggcggcuuauuacuuuuagcauuaauaacugcugccuuguauaaauuaggauuuuucaaaaggcaauauaaagauaugaugucugaaggagguccacccggagccgaaccacaauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4988 - RNA, 1751 nt, Artificial Sequence
  mRNA product Design3 comprising derived and/or modified sequence from Homo sapiens__NP_002415.1__HsMMP8 (opt13)
gggagagucccgcagucggcguccagcggcucugcuuguucgugugugugucguugcaggccuuauucaagcuuaccauguucucccucaaaacacuaccauucuuacuacuacuccauguacaaauauccaaagcauucccuguaucaucaaaagaaaaaaacacaaaaacaguacaagacuaccuagaaaaauucuaccaauuaccuucaaaccaauaccaaucaacaagaaaaaacggaacaaacguuauaguagaaaaacuaaaagaaaugcaacguuucuuugguuuaaauguaacagguaaaccaaacgaagaaacauuagacaugaugaaaaaaccaagauguggaguaccagacuccggcggauuuauguuaacaccaggaaauccaaaaugggaaagaacaaauuuaacuuaccgaauaagaaacuacacaccucaauuaagcgaagcagaaguagaaagagcaauaaaagaugccuucgaacuaugguccguagcaucaccucuaauuuucacaagaauaucacaaggagaagcagacaucaacauagcuuuuuaucaaagagaucacggagacaauucaccauuugauggaccaaacggaauccuagcacaugcauuucaacccggucaaggaauaggaggagacgcacacuucgaugccgaagaaacauggaccaacacuucagcaaacuacaaccuauuucuaguagcagcacaugaauucggccacucauuaggacucgcucauuccucagacccuggagcccuaauguaucccaacuaugcauucagagaaacaucaaacuauucacuaccucaagacgacauagauggaauucaagcuaucuacggauuaucaucaaacccaauucaaccaacaggaccaucaacacccaaaccuugugacccaucccuaacauuugacgcuauaacaacacuaagaggagaaauauuauucuucaaagacagauacuuuuggagaagacacccucaacuacaaagaguugaaaugaacuuuauaucauuauucuggccaucacuaccaacaggaauacaagcagcauacgaagacuucgauagagacuuaauauuccuuuucaaaggaaaccaauacugggcccuaaguggauacgacauauuacaagguuauccuaaagacauaucaaacuacggauuuccaucuucaguacaagcaauagacgcagcagucuucuauagaucaaaaacauacuuuuucguaaacgaccaauucuggagauaugacaaccaacgacaauuuauggaaccaggauauccaaaaucaauaucaggagcauucccuggaauagaauccaaaguagacgcaguauuucaacaagaacacuucuuccauguuuuuucaggaccaagauacuacgcuuuugacuuaauagcacaaagaguaacaagaguagcaagaggaaacaaauggcuaaacugccgauauggauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4989 - RNA, 2471 nt, Artificial Sequence
  mRNA product Design3 comprising derived and/or modified sequence from Homo sapiens__NP_004985.2__HsMMP9 (opt13)
gggagagucccgcagucggcguccagcggcucugcuuguucgugugugugucguugcaggccuuauucaagcuuaccaugucauuauggcaaccauuaguuuugguacuuuuaguauuaggauguuguuuugcugcaccacgucaaagacaaaguacauuaguccuauuuccaggcgauuuaagaacaaauuuaacagacagacaacuugcagaagaauaucuauauagauaugguuauacaagaguagcugaaaugagaggugaaucaaaaucucuaggaccagcauuauuacuacuacaaaaacaguuaucacuaccagaaaccggggaacuagacucagcuacacuuaaagcaaugagaacuccacgguguggagucccagaucucggucgguuucaaacauuugaaggagaccuuaaauggcaucaucacaauauaacauauuggauacagaauuauucagaagaccuaccaagagcgguuauagacgacgcauucgcccgagcauuugcacuauggagugcuguaacaccauugacuuuuacaaggguauauagucgagaugcagauaucguaauacaauuugguguagcagagcauggggauggauacccuuuugacgguaaagacggacuucuagcacaugcauuuccaccaggaccuggaauacaaggagaugcccauuuugaugacgacgaacuauggagucuuggaaaaggagucguaguaccuacaagauuugguaaugcugauggugcagcaugucauuuuccuuuuauauuugaaggacgaucuuacucugcaugcacuacagauggacguucagauggauuaccaugguguucuacuacagccaauuaugauacagaugauagauuugguuuuuguccuucagaacgauuauauacgcaagauggaaaugcagauggaaaaccuugucaauucccauuuauauuucaaggacaaucauauucagcauguacaacagauggacgaagcgauggauaucgauggugugcaacaacagcuaacuacgacagagauaaauuauuugguuuuuguccaacucgcgcugacucaacagucaugggugguaauagcgcuggugaauuauguguauuuccauuuacuuuccuuggcaaagaauacucaacaugcacaucggaaggaagaggagauggacgauuauggugugcaacuacuaguaauuucgacagugacaaaaaauggggauuuuguccggaccaaggguauucacuuuucuuaguugcagcacacgaauucggucaugcacuuggccuagaccauucaucaguaccugaagcucuuauguacccaauguauagauuuacagaaggaccuccacuccauaaagacgaugucaacggcauacgccaucuauaugguccacguccagagccugaaccaaggccucccacaacaacaacaccacaaccuacugcuccaccuacaguaugcccgacuggcccaccaacaguacauccaucugaaagaccaacggccggaccaacgggaccuccuucagcggguccaacaggaccaccaacagcaggccccagcacugccacuacaguaccauuaucaccuguggacgaugcuuguaauguuaauauauuugaugcaauagcugaaauugguaaucaacuguauuuauuuaaagauggaaaauauuggcgauuuagugaaggacgcggaucuagaccccaaggaccauuucuaauugccgauaaauggccagcccuaccuagaaaauuagauucuguauuugaagaaagauuaucaaaaaaauuauuuuuuuucucaggaagacaaguauggguuuauacaggagcaucaguacuaggaccuagaagacuagauaaacuagguuuaggagccgacgucgcacaaguuacaggcgcccuaagaucaggaagaggaaaaauguuauuauucagcgguagaagauuauggagauuugaugugaaagcacaaaugguugauccaagaucagcuagcgaagucgaucgaauguucccagguguaccauuggauacucaugauguuuuucaauauagagaaaaagcauauuuuugucaagauagauuuuauuggcguguuucaucuaggagugaauuaaaccaaguggaucaaguaggauauguaacauacgauauacuacaauguccagaagauuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4990 - RNA, 1763 nt, Artificial Sequence
  mRNA product Design3 comprising derived and/or modified sequence from Homo sapiens__NP_002418.1__HsMMP13 (opt13)
gggagagucccgcagucggcguccagcggcucugcuuguucgugugugugucguugcaggccuuauucaagcuuaccaugcacccaggaguauuagcagcauuccucuucuuaucauggacacacugccgagcauuaccauuaccaucaggaggagacgaagacgaucuaucagaagaagaccuucaauucgcagaaagauacuuaagaucauacuaccacccaacaaacuuagcagguauacuaaaagaaaacgcagccucuucaaugacagaaagacuuagagaaaugcaaucauucuucggauuagaaguaacaggaaaauuagaugacaauacacuagauguaaugaaaaaaccuagaugcggaguuccugacguaggagaauauaacgucuuuccaagaacauuaaaaugguccaaaaugaaccuaacauauagaauaguaaacuauacaccagauaugacccauucagaagucgaaaaagcauucaaaaaagcauucaaaguauggucagauguaacaccucuaaacuucacaagacuacaugacggaauagcagacaucaugauaagcuuuggaauaaaagaacacggagauuucuacccauucgacggaccaucuggauuauuagcccacgcauuucccccaggaccaaauuauggaggagacgcacauuucgaugacgaugaaacauggacaucaucaucaaaaggauacaaccuauucuuaguagcagcacacgaauucggacacucuuuaggcuuagaccauucaaaagaccccggagcacuaauguucccaauauauacauauacaggaaaaagccacuucauguuaccagacgaugacguccaagguauacaaagucuauacggaccaggagaugaagauccuaacccaaaacauccaaaaaccccagacaaaugugauccaucauuaucauuagaugccauaacaucauuacgaggagaaacaaugauuuucaaagaccguuucuucuggcgucuucacccacaacaagucgacgcagaacucuuuuuaacaaaaucguuuuggccugaacuaccaaacagaauagaugcagcauacgaacacccuagucacgacuuaauauuuauuuuucgaggacgaaaauucugggcccuaaauggauacgauauauuagaaggauacccuaaaaaaauaucugaacuaggauuaccaaaagaaguaaaaaaaauaucagccgcaguccacuuugaagauacaggaaaaacacuucuauuuucaggcaaucaagucuggagauacgacgacacaaaccacauaauggacaaagacuaccccagauuaauagaagaagacuucccaggcauaggugacaaaguagacgcaguauacgaaaaaaacggauauauauauuucuucaacggaccaauacaauuugaauacucuauauggucaaacagaauaguaagaguaaugccagcaaacuccauuuuauggugcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4991 - RNA, 1415 nt, Artificial Sequence
  mRNA product Design3 comprising derived and/or modified sequence from Homo sapiens__NP_001286.1__HsCCR1 (opt13)
gggagagucccgcagucggcguccagcggcucugcuuguucgugugugugucguugcaggccuuauucaagcuuaccauggaaacaccaaacacaacagaagacuacgauacaaccacagaauuugauuauggagacgcaacaccaugucaaaaaguaaacgaaagagccuuuggcgcgcaacuacuacccccauuauacucacuagucuucgucauaggacuaguagguaauauacuaguaguacuaguauuaguccaauacaaaagauuaaaaaauaugacaucaauauauuuacuaaacuuagcaauaucagauuuacuauuccuauucacauuaccauucuggaucgacuacaaacuaaaagacgacuggguauuuggagacgcaaugugcaaaauacucucaggauucuacuacacaggccuauacucugaaaucuucuucauaauacuacuaacaauagauagauaccuagcaauaguucaugcaguauucgcauuaagagccagaaccgucacauucggagucauaacaucaauaauaauaugggccuuagcaauauuagcaucaaugccaggacuauacuuuucuaaaacacaaugggaauucacacaucauacaugcucacuucacuucccucacgaaucccuaagagaauggaaacucuuccaagcauuaaaacucaaucuuuucggacuaguacuaccccuacucguaaugaucauaugcuacacaggaauaauaaaaauacuacuacgacgaccaaacgaaaaaaaaucaaaagcaguaagauuaauauucguaauaaugaucaucuucuuccuuuuuuggaccccuuacaaccucacaauacuaauaucaguauuccaagacuuuuuauucacacacgaaugugaacaauccagacaucucgacuuagcaguacaagucaccgaaguaauagcauacacacacuguugcguuaaccccguaauauacgcuuuuguaggagaaagauuccgaaaauaucuaagacaacuauuucacagacgaguugcaguacacuuagucaaaugguuaccauuucuaucaguagauagauuagaaagagucucauccacaucaccaucaaccggagaacacgaauuaucagcaggauucuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4992 - RNA, 983 nt, Artificial Sequence
  mRNA product Design3 comprising derived and/or modified sequence from Homo sapiens__NP_002598.4__HsPDGFA (opt13)
gggagagucccgcagucggcguccagcggcucugcuuguucgugugugugucguugcaggccuuauucaagcuuaccaugagaacacuagcaugccuacuauuacuaggaugcggauaccuagcacauguacuagcugaagaagcagaaauaccaagagaaguaauagaaagacuagcaagaucacaaauacacucaauaagagaccuacaacgacuacuagaaauagacucagucggaagugaagacucacucgacacaagucuaagagcacacggaguacacgcaacaaaacacguaccagaaaaaagaccacuacccauaagaagaaaaagaagcauagaagaagcaguaccagcaguaugcaaaacacgaacaguaauauacgaaauaccaagaucacaaguagacccaacaucagcaaacuuccuaauauggcccccaugcguagaaguaaaaagaugcacaggaugcugcaacacaucaagcguaaaaugccaaccaagcaggguacaccacagaagcgucaaaguagcaaaaguagaauacguaagaaaaaaaccaaaacuaaaagaaguacaaguaagacuagaagaacaccuagaaugcgcaugugcaacaacaagccuaaauccagauuacagagaagaagacacaggaagaccaagagaaagcggaaaaaaaagaaaaagaaaaagacuaaaaccaacauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4993 - RNA, 1073 nt, Artificial Sequence
  mRNA product Design3 comprising derived and/or modified sequence from Homo sapiens__NP_002599.1__HsPDGFB (opt13)
gggagagucccgcagucggcguccagcggcucugcuuguucgugugugugucguugcaggccuuauucaagcuuaccaugaacagaugcugggcauuauucuuaucauuaugcuguuaccuaagauuaguaucagcagaaggagauccaauaccagaagaacuauacgaaaugcuaagcgaucacaguauaagaagcuuugacgaucuacaaagauuacuucacggcgauccaggagaagaagacggagcagaauuagaccuaaauaugacaagaucacacucaggaggagaauuagaaucacuagcacguggaagaagaagccuaggaagucuaacaauagcagaaccugcaaugauagcagaauguaaaacacgaacagaaguauucgaaauaucaagaagauuaauagauagaacaaaugcaaauuucuuaguauggccaccauguguagaaguacaaagaugcaguggaugcugcaauaacagaaacguacaauguagaccaacacaaguacaauuaagaccaguacaaguaagaaaaauagaaauaguaagaaaaaaaccaauauuuaaaaaagcaacagucacauuagaggaccaccucgcaugcaaaugugaaaccguagcagcagcaagaccaguaacaagaagcccaggcggaagccaagaacaaagagcaaaaacaccacaaacuagaguuacaauaagaacaguaagaguacgaaggcccccaaaaggaaaacauagaaaauucaaacacacacacgacaaaacagcacuaaaagaaacacuaggagcguaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4994 - RNA, 1385 nt, Artificial Sequence
  mRNA product Design3 comprising derived and/or modified sequence from Homo sapiens__NP_057289.1__HsPDGFC (opt13)
gggagagucccgcagucggcguccagcggcucugcuuguucgugugugugucguugcaggccuuauucaagcuuaccaugucauuauuuggauuauuacuacuuacaucagcauuagcaggacaaagacaagguacacaagcagaaagcaaucuaucaagcaaauuccaauuuucauccaauaaagaacaaaauggaguacaagacccacaacacgaaagaauaauaaccgucagcacaaacggcucaauacauaguccacgauucccacauacauauccaagaaacaccguacucgucuggagauuaguagcaguugaagaaaauguauggauccaauuaacauucgacgaaagauuuggauuagaagacccugaagacgacauaugcaaauacgacuuuguagaaguagaagaaccaucagacggaacaauauuaggacgauggugcggaucagguacaguaccugguaaacaaaucucaaaaggcaaccaaauaagaauaagauucguaagcgaugaauacuucccaagugaaccaggauucuguauacauuacaauaucgucaugccacaauucacagaagcaguaucaccaucaguacuaccaccaucagcucuaccauuagacuuacuaaauaacgcuauaacagcauuuucaacauuagaagacuuaauacgauacuuagaaccagaaagauggcaacuagaccuagaagaccuauacaggccaacauggcaacuucuaggaaaagcauuuguauuuggaagaaaaucacgaguugucgaucuaaaccuauuaacagaagaaguaagacuuuacucaugcacaccaagaaacuuuucaguauccauaagagaagaacuaaaaagaacagauacaauauucuggccaggaugccuacuaguaaaaagaugcggcggaaauugcgcaugcugcuuacacaacuguaacgaaugccaaugcguaccaucaaaaguuacaaaaaaauaccacgaaguacuacaauuaagacccaaaacuggaguuagaggacuacauaaaucucuaacagacguagcacuagaacaucacgaagaaugugacugcguuugccgaggaagcacaggaggcuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4995 - RNA, 1442 nt, Artificial Sequence
  mRNA product Design3 comprising derived and/or modified sequence from Homo sapiens__NP_149126.1__HsPDGFD (opt13)
gggagagucccgcagucggcguccagcggcucugcuuguucgugugugugucguugcaggccuuauucaagcuuaccaugcacagauuaauauuuguauacacacuaauaugugcaaacuucugcucaugcagagacacauccgcaacuccacaaucagcaucaauaaaagcuuuaagaaacgcaaaucuaagaagagacgaucuauacagaagagacgaaaccauacaaguaaaaggaaacggcuacguacaaagcccacgauucccuaacucauacccaagaaaucuauuauuaacauggcgacuacacucccaagaaaacacaagaauacaacuaguauucgauaaccaauucggauuagaagaagcagaaaacgacauauguagauaugauuucguagaaguagaagacauaucagaaacaucaacuauaauacgaggaagauggugcggacacaaagaaguaccaccacgaauaaaaucaagaacaaaccaaauaaaaauaacuuucaaaucagaugacuacuucguugcaaaacccggauucaaaauauauuauagccuacuagaagacuuccaaccagcagcagcuucagaaacaaauugggaaucagucacaagcucaauaucaggaguaucauauaauagcccaucaguuacagacccaacacuaaucgccgacgcauuagacaaaaaaauagcagaauucgauacaguagaagaucuacuaaaauacuuuaacccugaaucauggcaagaagaucuagaaaacauguaucuagacacacccagauacagaggaagaagcuaccacgacagaaaaucaaaaguagacuuagacagacuaaaugaugacgcaaaaagauacucaugcacaccaagaaacuacagcguaaauauaagagaagaacuaaaauuagcaaacguaguauucuucccaagaugucuauuaguacaacgcugcggaggaaacuguggaugcggaacaguaaacuggcgaagcuguacaugcaauuccggaaaaacagucaaaaaauaccacgaaguacuacaauucgaacccggacauauaaaaagaagagguagagcaaaaacaauggcacuaguagauauacaauuagaccaccaugaaagaugcgauuguauaugcagcucuagaccuccaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4996 - RNA, 1025 nt, Artificial Sequence
  mRNA product Design3 comprising derived and/or modified sequence from Homo sapiens__NP_003946.3__HsSOCS3 (opt13)
gggagagucccgcagucggcguccagcggcucugcuuguucgugugugugucguugcaggccuuauucaagcuuaccauggucacccauucaaaauucccagcagcaggaaugucaagaccauuagacacaucauuacgauuaaaaacauucucaucaaaaucagaauaccaacuaguaguaaaugcaguaagaaaacuacaagaaucaggauucuauuggucagcaguaacaggaggagaagcaaauuuauuacuaucagcagaaccagcaggaacuuuccuaauacgagacucaucagaccaacgacacuucuuuacucuaucaguaaaaacacaaucaggaacaaaaaaccucagaauacaaugugaaggaggaucauucucccuacaaucagaccccagaucaacacaacccguaccaagauucgacugcguacuaaaacuaguacaccacuacaugccaccacccggagcaccauccuucccaucuccaccaacagaaccaucaucugaaguaccugaacaaccaucagcacaaccacuaccuggaucaccaccaagaagagcauacuacauauacucaggaggagaaaaaauaccacuaguacuuucaagaccacuaucaucuaauguagcaacacuacaacacuuaugccgaaaaacaguaaacggccaccuagacucauacgaaaaagucacacaacuaccaggaccaauaagagaauucuuagaucaauacgacgcaccacuauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4997 - RNA, 830 nt, Artificial Sequence
  mRNA product Design3 comprising derived and/or modified sequence from Homo sapiens__NP_003227.1__HsTGFA (opt13)
gggagagucccgcagucggcguccagcggcucugcuuguucgugugugugucguugcaggccuuauucaagcuuaccaugguaccaucagcaggacaauuagcauuauuugcacuaggaauaguacuagcagcaugucaagcauuagaaaacucaacaucaccacuaucagcagacccaccaguagcagcagcaguaguaucacauuuuaaugauugcccagacucacacacacaauucugcuuucacggaacauguagauuucuaguacaagaagacaaaccagcauguguaugucauucaggauauguaggagcaagaugugaacaugcagauuuauuagcaguaguagcagcaucacaaaaaaaacaagcaauaacugcauuaguaguaguaaguauaguagcauuagcaguauuaauaauaacauguguauuaauacauugcugucaaguaagaaaacauugugaauggugcagagcauuaauauguagacaugaaaaaccuucagcauuacuaaaaggaagaacagcaugcugucacucagaaacaguaguauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4998 - RNA, 1520 nt, Artificial Sequence
  mRNA product Design3 comprising derived and/or modified sequence from Homo sapiens__NP_000651.3__HsTGFB1 (opt13)
gggagagucccgcagucggcguccagcggcucugcuuguucgugugugugucguugcaggccuuauucaagcuuaccaugccaccaucaggucuacgacuacuaccucucuuacuaccuuuacuauggcuccucguacuaaccccaggccgaccagcagcuggccuaucaacaugcaaaacaauagacauggaauuagucaaaagaaaaagaauagaagcaauuagaggacaaauacuaucaaaauuaagauuagccuccccaccuucucaaggagaaguaccaccagguccacuaccugaagcaguccuagcacuauacaacucaacaagagacagaguagcaggagaauccgcagaaccagaacccgaaccagaagcagacuauuaugcaaaagaagucaccagaguacuaaugguagaaacacauaaugaaaucuacgauaaauuuaaacaaucaacacauucaauauacauguuuuucaacacaagugaacuaagagaagcaguaccagaaccaguauuacuaucacgagccgaauuaagacuccuaagacuuaaacuaaaaguagaacaacacguugaauuauaccaaaaauacucuaacaacucauggagauacuuaucuaaucgacuacuagcacccucagacucaccagaauggcucucauucgacguaaccggaguaguacgacaauggcuaucccguggcggugaaauagaaggauucagacuauccgcacacugcucuugcgacucaagagacaauacauuacaaguagauauaaacggauucacaacaggaagaagaggagacuuagcuacaauccacggaaugaaccgccccuuccuacuauuaauggcaacuccucuagaaagagcacaacacuuacaauccucaagacacagaagagcacuagacacaaacuauuguuucucaagcacugaaaaaaacugcugcguccgacaauuauacauagacuuccgaaaagaucucggauggaaauggauacacgaaccaaaaggauaccacgccaacuucugccucgguccauguccauauaucuggucacuagauacacaauacuccaaaguacuagcauuauauaaccaacauaauccaggagcaucagcagcgccaugcugcguaccacaagcauuagaaccacucccaauaguauacuaugucggaagaaaaccaaaaguagaacaacuaucaaacaugauagucagaucaugcaaauguucuuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 4999 - RNA, 1592 nt, Artificial Sequence
  mRNA product Design3 comprising derived and/or modified sequence from Homo sapiens__NP_003229.1__HsTGFB2 (opt13)
gggagagucccgcagucggcguccagcggcucugcuuguucgugugugugucguugcaggccuuauucaagcuuaccaugcacuauugcguacuuucagcauuucuaauauuacaccuaguaacagucgcuuuaaguuuaagcacaugcucaaccuuagacauggaccaauuuaugagaaaacgaauagaagcaauaagaggacaaauauuauccaaacuaaaacuaacaucaccacccgaagauuauccagaaccagaagaagucccaccagaaguaauaucaauauauaacagcacaagagaccuccuacaagaaaaagcaucaagaagagcagcagcaugcgaacgagaaagaucagaugaagaauauuacgcuaaagaaguauacaaaauagacaugccccccuucuuuccaucagaaaaugcaauaccaccaaccuuuuacagacccuauuuucgaauaguaagauucgauguaucagccauggaaaaaaacgcaucaaaccuagucaaagcggaauucagaguauuccgacuucaaaacccaaaagcuagaguucccgaacaacgaaucgaacuauaucaaauacuaaaaucaaaagaccuaaccucacccacacaaagauacauagacucaaaaguaguaaaaaccagagcagagggcgaaugguuaucauucgacguaacagacgcaguacacgaauggcuacaucacaaagaccgaaaucucggauucaaaauaucacuacacugcccaugcugcacauucgucccaucaaacaacuauauaauaccaaauaaaucagaagaacuugaagcaagauuugcuggaauagacggaacaaguacauacaccucuggagaccaaaaaacuauaaaaucaacaagaaaaaaaaacucuggcaaaacaccucaccuacuauuaaugcuacuacccucauacagacuagaaucacaacaaacaaaccgaagaaaaaaaagagcacuagacgcagcauacuguuucagaaacguacaagauaacugcugccucagaccacuauauauagacuucaaaagagaccuaggauggaaauggauacaugaaccaaaaggcuacaacgccaacuucugcgcaggagcaugcccauacuuauggucaucugacacacagcacucaagaguacuaucacuauacaacacaauaaauccagaagcuucagcaagucccugcugcguaucacaagacuuagaacccuuaacuauauuauauuauaucggaaaaacaccaaaaauagaacaacuaucaaacaugauaguaaaaucauguaaauguaguuaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5000 - RNA, 1586 nt, Artificial Sequence
  mRNA product Design3 comprising derived and/or modified sequence from Homo sapiens__NP_003230.1__HsTGFB3 (opt13)
gggagagucccgcagucggcguccagcggcucugcuuguucgugugugugucguugcaggccuuauucaagcuuaccaugaaaaugcaccuccaaagagcccucgucguucucgcacuacuaaacuucgcaaccguaucacuaucccuaucaacaugcacaacccuagacuucggacacauaaaaaaaaaaagaguagaagcaauccgaggccaaauuuuaucaaaacuaagacuaacaucaccaccagaacccacagucaugacacacguaccauaccaaguccuagcacuauacaacucaacacgagaacuauuagaagaaaugcacggagaaagagaagaaggauguacacaagaaaacacugaaagugaauacuaugcaaaagaaauacacaaauucgauaugauacaaggacuagcagaacacaacgaacuagcaguaugcccaaaaggaauaacaucaaaaguauuucgauucaacguaucaucaguagagaaaaaucgaacaaaccuauuuagagccgaauuuagaguccuaagaguccccaauccaucaucaaaaagaaacgaacaacgcauagaacuauuucaaauacuacgcccagacgaacacauagcaaaacaaagauacauagguggaaaaaaccucccaaccagaggaacagccgaauggcuaucauucgacguaacagacaccgucagagaauggcuacuccgcagagaaucaaacuuaggucuagaaauaucaauacacugcccaugccauacauuucaaccaaauggagacauauuagaaaacauacaugaaguaauggaaaucaaauucaaaggaguagacaacgaagacgaccacggacgaggcgaccucggcagacuaaaaaaacaaaaagaucaccacaauccacaccuaauccuaaugaugauacccccccacagacuagacaacccaggacaaggaggacaacgaaaaaaaagagcacucgacacaaauuauuguuuccgaaaucuagaagaaaacugcugcguccguccacuuuacauagacuucagacaagaccuaggauggaaauggguucacgaaccaaaaggauauuaugccaacuucugcucaggacccugcccauacuuaagaucagcagacacaacacacucuacaguacuaggacuauacaacacacuaaacccagaagccucagcaucacccugcugugucccacaagaccuagaaccuuuaaccauacuauacuacguaggaagaacuccuaaaguagaacaacuuucaaauaugguaguaaaaucaugcaaaugcucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5001 - RNA, 1733 nt, Artificial Sequence
  mRNA product Design3 comprising derived and/or modified sequence from Homo sapiens__NP_001057.1__HsTNFRSF1B (opt13)
gggagagucccgcagucggcguccagcggcucugcuuguucgugugugugucguugcaggccuuauucaagcuuaccauggcaccaguagcaguaugggcagcacuugcaguaggacucgaauuaugggcagcagcacaugcauuaccugcacaaguugcauucacacccuacgcacccgaaccaggcucaaccuguagauuaagagaauauuacgaucaaacagcucaaaugugcuguucuaaaugcucaccuggccaacaugcaaaaguauuuugcacuaaaacaucugauaccguaugugauucuugugaagacucaacauauacacaacuauggaacuggguuccagaaugucuaucaugcggaucaagauguucaucagaccaaguugaaacacaagcauguacucgugaacaaaaucgaauuugcacauguagaccaggaugguauugcgcuuuaucgaaacaagaaggauguagacuaugcgcaccucuuagaaaaugcagaccaggcuuuggagucgcucgacccggaacugaaacaucagacguaguaugcaaaccuugugcaccagguacauucucuaacacaacaaguucaacagauauuuguagaccacaccaaauauguaacguaguugcuauaccaggaaacgcaucuauggaugcaguauguacaucuacgucaccuaccagaucaauggcaccaggagcaguucacuuaccacaaccaguaucaacaagaagucaacacacacaaccaacaccugaacccucaacugcaccaagcacuucauuucuacuaccaaugggucccucaccaccugcugaaggaucaacaggagacuucgcauuaccugucggacuuaucguaggaguuacagcauuaggacuauuaauaaucgguguaguaaauuguguuauuaugacacaaguaaaaaaaaaacccuuauguuuacaaagagaagccaaaguaccucauuuaccagcagauaaagccagaggaacccaagguccagaacaacaacauuuauuaaucacagcucccucaucaucaucaucaucuuuagaaucaucagcaagugcucuagauagaagagcucccacaagaaaccaaccucaagcaccaggugucgaagcaucaggagcuggugaagcucgugcuucuacgggaucuucagauucaucacccggaggacacggaacacaaguaaauguaacaugcauaguaaaugucuguuccaguucggaucauucaucacaauguucaucacaagcaucaucuacuaugggagauacagauaguucaccaucagaauccccaaaagacgaacaaguaccauuuucaaaagaagaaugcgcauuuagaucacaauuagaaacaccagaaacauuauuaggaucaacugaagaaaaaccacuaccacuaggcguaccagaugcaggaaugaaacccucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5002 - RNA, 860 nt, Artificial Sequence
  mRNA product Design3 comprising derived and/or modified sequence from Homo sapiens__NP_002623.2__HsPGF (opt13)
gggagagucccgcagucggcguccagcggcucugcuuguucgugugugugucguugcaggccuuauucaagcuuaccaugccaguaaugagauuauuuccauguuucuuacaauuauuagcaggauuagcauuaccagcaguaccaccacaacaaugggcguuaucagcaggaaauggaaguagugaaguagaaguaguaccauuucaagaaguauggggaagaucauauuguagagcacuagaaagacuaguagauguaguaagugaauauccaagcgaaguagaacauauguuuucaccaucauguguaaguuuauuaagauguacgggaugcuguggagaugaaaauuuacauuguguaccaguagaaacagcaaauguaacaaugcaauuauuaaaaauaagaaguggagauagaccaucauauguagaauuaacauuuagccaacauguaagaugugaauguagaccauuaagagaaaaaaugaaaccagaaagaagaagaccaaaaggaagaggaaaaagaagaagagaaaaacaaagaccaacagauugucauuuauguggagaugcaguaccaagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5003 - RNA, 1586 nt, Artificial Sequence
  mRNA product Design3 comprising derived and/or modified sequence from Homo sapiens__NP_001020537.2__HsVEGFA (opt13)
gggagagucccgcagucggcguccagcggcucugcuuguucgugugugugucguugcaggccuuauucaagcuuaccaugacagauagacaaacagauacagcgccaaguccaucauaccauuuauuaccaggaagaagaagaacaguagaugcagcagcgaguagaggacaaggaccagagccagcaccaggaggaggaguagaaggaguuggagcaagaggaguagcgcuaaaauuauuuguacaacuauuaggaugcaguagauucgguggagcaguaguaagagcuggagaagcagaaccauccggugcagccagaagcgcaaguaguggaagagaagaaccacaaccagaagaaggagaagaagaagaagaaaaagaagaggaaagaggaccacaauggagacuuggcgcuagaaaaccugggagcuggacaggagaagcagcuguaugcgcagauagugcaccagcagcaagagcaccacaagcauuagcaagagcaucaggacgaggaggaagaguagcaagaaggggagccgaagaaaguggaccuccacauaguccaaguagaagaggaucagcaaguagagcugggccaggaagggcaucugaaacaaugaauuuuuuauuaaguuggguacauuggaguuuagcuuuauugcuauauuuacaucacgcaaaauggagucaagcagcaccaauggcagaaggagggggacaaaaucaucacgaaguaguaaaauuuauggauguuuaucaaaggaguuauugucauccuauagaaacguuaguagauauauuucaagaauacccagaugaaauagaguauauauuuaaaccgaguuguguaccauuaaugagauguggaggauguuguaaugacgaaggacuagaauguguaccaacagaagaaagcaauauaacuaugcagauaaugagaauaaaaccucaucaaggacaacauauaggagaaaugaguuuuuugcaacacaauaagugcgaauguagaccaaaaaaagaucgagcaagacaagaaaaaaaaagcguaagagguaaagguaaaggacaaaaaagaaaaagaaaaaaaaguagauauaaaagcuggaguguauacguaggggcaagauguuguuugaugccauggagccucccaggaccucauccguguggaccauguucagagagaagaaaacaucuguuuguacaagauccacaaacauguaaaugcaguugcaaaaauacggauucaagauguaaagcgagacaauuagaauuaaaugaaaggacauguagaugcgauaagccgagaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5004 - RNA, 1046 nt, Artificial Sequence
  mRNA product Design3 comprising derived and/or modified sequence from Homo sapiens__NP_001165094.1__HsVEGFA (opt13)
gggagagucccgcagucggcguccagcggcucugcuuguucgugugugugucguugcaggccuuauucaagcuuaccaugaacuucuuacuaucauggguacauuggagcuuagcacuauuacuauaccuacaccacgcaaaauggucacaagcagcaccaauggcagaaggaggaggacaaaaccaccaugaaguaguaaaauucauggauguauaccaaagaucauacugccacccaauagaaacacuaguagacauauuccaagaauacccagacgaaauagaauacauauucaaaccaucauguguaccauuaaugagaugcggaggaugcugcaacgacgaaggacuagaauguguaccaacagaagaaaguaacauaacaaugcaaauaaugagaauaaaaccacaucaaggacaacacauaggagaaaugagcuuccuacaacacaauaaaugcgaaugcagaccaaaaaaagacagagcaagacaagaaaaaaaaaguguaagaggaaaaggaaaaggacaaaaaagaaaaagaaaaaaaucaagauacaaaucauggucaguauacguaggagcaagaugcugccuaaugccauggucacuaccaggaccacacccaugcggaccaugcucagaaagaagaaaacaccuauucguacaagacccacaaaccugcaaaugcaguugcaaaaacacagacagcagaugcaaagcaagacaauuagaacuaaacgaaagaacaugcagaugcgauaaaccacgaagauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5005 - RNA, 971 nt, Artificial Sequence
  mRNA product Design3 comprising derived and/or modified sequence from Homo sapiens__NP_003368.1__HsVEGFB (opt13)
gggagagucccgcagucggcguccagcggcucugcuuguucgugugugugucguugcaggccuuauucaagcuuaccaugucaccacuauuaagaagauuauuacuagcagcauuacuacaauuagcacccgcacaagcaccuguaucacaaccagaugcaccaggacaucaaagaaaaguaguaucauggauagacguauacacaagagcaacaugucaaccaagagaaguaguaguaccauuaacaguagaacuaaugggaacagucgcaaaacaacuaguaccaucaugcguaacaguacaaagaugcggaggcuguuguccagacgauggauuagaauguguuccaacaggacaacaucaaguaagaaugcaaauacuaaugauaagauacccaucaucucaacuaggagaaauguccuuagaagaacauagucaaugcgaaugcagaccaaaaaaaaaagauucagcaguaaaaccagaccgagcagcaacaccacaucauagaccacaaccacgaucaguaccaggcugggacucagccccaggagcaccaucaccagcagauauaacccaucccacaccugcaccaggaccaucugcacaugcagcaccuucaacaacaucagcauuaacaccaggaccagcagcagcagccgcagacgcagcugcaucaucaguagcaaaaggaggagcauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5006 - RNA, 1607 nt, Artificial Sequence
  mRNA product Design3 comprising derived and/or modified sequence from Homo sapiens__NP_005420.1__HsVEGFC (opt13)
gggagagucccgcagucggcguccagcggcucugcuuguucgugugugugucguugcaggccuuauucaagcuuaccaugcaccucuuaggauucuucucaguagcuugcucauuauuagccgccgccuuauuaccaggaccaagagaagcaccagcagcagccgcagcauuugaaucaggauuagacuuaagugaugcugaaccagacgcaggagaagcuacagcauaugccaguaaagacuuagaagaacaauuaagaucaguaaguuccguagacgaauuaaugacaguacucuauccagaauacuggaaaauguauaaaugucaacuaagaaaaggcggauggcaacauaauagggaacaagcaaaucuaaauucaagaacagaagaaacuauaaaauucgcagccgcacacuauaacacggaaauacuaaaaaguauagauaacgaauggagaaaaacacaaugcaugccaagagaaguaugcauagauguaggaaaagaauuuggaguagcaacaaacacauuuuucaaaccaccauguguaagcguauacagauguggcgguugcugcaauagcgaaggauuacaauguaugaacacuagcacuucauacuuaucaaaaacacuauuugaaauuacaguaccauuaagucaaggaccuaaaccaguaacgauaaguuuugcaaaccacacaucauguagauguaugucaaaacuagauguauauagacaaguacacucaauaauaagaagaucacuaccagcaacacuuccacaaugccaagcagcaaauaaaacauguccaacaaacuauauguggaacaaccacauaugcagaugucuagcacaagaagauuucauguuuaguucagacgcaggagacgacagcacagauggauuucaugacauaugcggacccaacaaagaauuagacgaagaaacuugucaaugcguauguagagcaggacuacgaccagcaucauguggaccacauaaagaauuagacagaaacaguugccaaugcguaugcaaaaauaaacuauucccaucacaauguggagcaaaucgagaauuugaugaaaacacaugucaauguguaugcaaaagaacaugcccaagaaaucaaccauuaaauccagguaaaugcgcaugugaauguacagaaucaccacaaaaaugccuauuaaaaggaaagaaauuucaccaucaaacaugcaguuguuauagaagaccauguacaaauagacaaaaagccugugaaccaggauucuccuacucagaagaaguauguagauguguaccaaguuacuggaaaagaccacaaaugucauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5007 - RNA, 1412 nt, Artificial Sequence
  mRNA product Design3 comprising derived and/or modified sequence from Homo sapiens__NP_004460.1__HsVEGFD (opt13)
gggagagucccgcagucggcguccagcggcucugcuuguucgugugugugucguugcaggccuuauucaagcuuaccauguaccgagaauggguaguaguaaacguauucaugaugcuuuacguacaacuaguacaaggaucaucaaaugaacacggaccaguaaaaagaucaagccaaucaacauuagaaagaucagaacaacaaauacgagcagcaucaucacucgaagaacuccuaagaauaacacacuccgaagacuggaaacuauggcgaugcagacuaagauuaaaaucauucacaucaauggauucacgcuccgcaucccacagaucaacaagauuugccgccacauuuuacgacauagaaacauuaaaagucaucgacgaagaauggcaacgaacacaaugcucaccuagagaaacaugcguagaaguagcaucagaacuagguaaauccacaaauaccuuuuuuaaaccaccuugcguaaacguauucagaugcggaggcuguugcaacgaagaaucacuaauuuguaugaacacaucuacauccuacauaucaaaacaacuauucgaaauaucaguaccacuaacaagcguacccgaacuaguccccguaaaaguagcaaaccacacaggaugcaaaugccuaccaacagcaccaagacauccauacuccauaauacgaagaucaauacaaauaccagaagaagacagaugcucacacucaaaaaaacuaugcccuauagauaugcuaugggacagcaacaaaugcaaaugcguacuacaagaagaaaacccucuagcaggaaccgaagaccacagccaucuacaagaaccagcauuaugcgguccacauaugauguucgacgaagacagaugcgaaugcguaugcaaaacaccaugccccaaagaccuuauacaacacccuaaaaacuguagcugcuuugaaugcaaagaaucacuagaaacaugcugccaaaaacacaaauuauuucacccagacacaugcucaugcgaagacagaugcccauuccacaccagaccaugcgcauccgguaaaacagcaugugcaaaacacugcagauuccccaaagaaaaaagagcagcccaaggaccacacucaagaaaaaauccauaaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaagaauu

SEQ ID NO: 5008 - RNA, 978 nt, Artificial Sequence
  mRNA product Design4 comprising derived and/or modified sequence from Homo sapiens__NP_001133.1__HsAMELX (opt1)
gggucccgcagucggcguccagcggcucugcuuguucgugugugugucguugcaggccuuauucaagcuuaccaugggcaccuggauccuguucgccugccuccugggggccgcguucgccaugccccugccgccccaccccggccaccccggguacaucaacuucagcuacgaggugcucaccccgcugaagugguaccaguccauccgcccgcccuaccccagcuacggcuacgagcccaugggcggguggcugcaccaccagaucauccccguccucucccagcagcacccgcccacgcacacccugcagccgcaccaccacauccccguggugcccgcccagcagcccgucaucccccagcagcccaugaugcccgugcccggccagcacagcaugaccccgauccagcaccaccagcccaaccugcccccgccggcccagcagcccuaccagccccagcccgugcagccccagccccaccagcccaugcagccgcagccgcccguccaccccaugcagccgcucccgccccagcccccgcugccgcccauguuccccaugcagccccugccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5009 - RNA, 609 nt, Artificial Sequence
  mRNA product Design4 comprising derived and/or modified sequence from Homo sapiens__NP_001133.1__HLA-A2-SP_HsAMELX(17-60) (opt1)
gggucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgcccuaccccagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5010 - RNA, 642 nt, Artificial Sequence
  mRNA product Design4 comprising derived and/or modified sequence from Homo sapiens__NP_001133.1__HLA-A2-SP_HsAMELX(17-47,168-191) (opt1)
gggucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucagcuacgaggugcucaccccgcugaagugguaccaguccauccgcccgccgcccaugcuccccgaccugacccuggaggccuggcccuccacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5011 - RNA, 972 nt, Artificial Sequence
  mRNA product Design4 comprising derived and/or modified sequence from Sus scrofa__NP_999071.1__SsAMEL (opt1)
gggucccgcagucggcguccagcggcucugcuuguucgugugugugucguugcaggccuuauucaagcuuaccaugggcaccuggauccuguucgccugccuccugggggccgcguucagcaugccccugccgccccaccccggccaccccggguacaucaacuucuccuacgaggugcucaccccgcugaagugguaccagaacaugauccgccaccccuacacgagcuacggcuacgagcccaugggcggguggcugcaccaccagaucauccccgucgugucccagcagaccccgcagagccacgcccuccagccccaccaccacauccccauggugcccgcccagcagccgggcaucccccagcagcccaugaugccccugccggggcagcacuccaugacccccacccagcaccaccagcccaaccugccccucccggcccagcagcccuuccagccccagcccguccagccgcagccccaccagccccugcagccccagagcccgaugcaccccauccagccccugcucccgcagccgccccugcccccgauguucuccaugcagagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5012 - RNA, 612 nt, Artificial Sequence
  mRNA product Design4 comprising derived and/or modified sequence from Sus scrofa__NP_999071.1__HLA-A2-SP_SsAMEL(17-61) (opt1)
gggucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccuacacgagcuacggcuacgagcccaugggcggguggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5013 - RNA, 645 nt, Artificial Sequence
  mRNA product Design4 comprising derived and/or modified sequence from Sus scrofa__NP_999071.1__HLA-A2-SP_SsAMEL(17-49,167-189) (opt1)
gggucccgcagucggcguccagcggcucugcuuguucgugugugugucguugcaggccuuauucaagcuuaccauggccgugauggccccgcggacccugguccuccugcugagcggcgcgcucgcccugacccagacgugggccaugccccugccgccccaccccggccaccccggguacaucaacuucuccuacgaggugcucaccccgcugaagugguaccagaacaugauccgccaccccagccugcuccccgaccugccccuggaggccuggcccgcgacggacaagaccaagcgggaggagguggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 5014 - DNA, 42 bp, Artificial Sequence
  5-UTR of human ribosomal protein Large 32 lacking the 5 terminal oligopyrimidine tract
ggcgctgcctacggaggtggcagccatctccttctcggcatc

SEQ ID NO: 5015 - RNA, 42 nt, Artificial Sequence
  5-UTR of human ribosomal protein Large 32 lacking the 5 terminal oligopyrimidine tract mRNA
ggcgcugccuacggagguggcagccaucuccuucucggcauc

SEQ ID NO: 5016 - DNA, 75 bp, Artificial Sequence
  5-UTR of human mitochondrial ATP synthase subunit alpha lacking the 5 terminal oligopyrimidine tract
gcggctcggccattttgtcccagtcagtccggaggctgcggctgcagaagtaccgcctgcggagtaactgcaaag

SEQ ID NO: 5017 - RNA, 75 nt, Artificial Sequence
  5-UTR of human mitochondrial ATP synthase subunit alpha lacking the 5 terminal oligopyrimidine tract mRNA
gcggcucggccauuuugucccagucaguccggaggcugcggcugcagaaguaccgccugcggaguaacugcaaag

SEQ ID NO: 5018 - DNA, 62 bp, Artificial Sequence
  5-UTR of human peroxisomal multifunctional enzyme type 2 lacking the 5 terminal oligopyrimidine tract
gtcccgcagtcggcgtccagcggctctgcttgttcgtgtgtgtgtcgttgcaggccttattc

SEQ ID NO: 5019 - RNA, 62 nt, Artificial Sequence
  5-UTR of human peroxisomal multifunctional enzyme type 2 lacking the 5 terminal oligopyrimidine tract mRNA
gucccgcagucggcguccagcggcucugcuuguucgugugugugucguugcaggccuuauuc

SEQ ID NO: 5020 - DNA, 110 bp, Artificial Sequence
  3-UTR of Homo sapiens hemoglobin, alpha 1 (HBA1)
gctggagcctcggtggccatgcttcttgccccttgggcctccccccagcccctcctccccttcctgcacccgtacccccgtggtctttgaataaagtctgagtgggcggc

SEQ ID NO: 5021 - RNA, 110 nt, Artificial Sequence
  3-UTR of Homo sapiens hemoglobin, alpha 1 (HBA1) mRNA
gcuggagccucgguggccaugcuucuugccccuugggccuccccccagccccuccuccccuuccugcacccguacccccguggucuuugaauaaagucugagugggcggc

SEQ ID NO: 5022 - DNA, 108 bp, Artificial Sequence
  3-UTR of Homo sapiens hemoglobin, alpha 2 (HBA2)
gctggagcctcggtagccgttcctcctgcccgctgggcctcccaacgggccctcctcccctccttgcaccggcccttcctggtctttgaataaagtctgagtgggcag

SEQ ID NO: 5023 - RNA, 108 nt, Artificial Sequence
  3-UTR of Homo sapiens hemoglobin, alpha 2 (HBA2) mRNA
gcuggagccucgguagccguuccuccugcccgcugggccucccaacgggcccuccuccccuccuugcaccggcccuuccuggucuuugaauaaagucugagugggcag

SEQ ID NO: 5024 - DNA, 132 bp, Artificial Sequence
  3-UTR of Homo sapiens hemoglobin, beta (HBB)
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 5025 - RNA, 132 nt, Artificial Sequence
  3-UTR of Homo sapiens hemoglobin, beta (HBB) mRNA
gcucgcuuucuugcuguccaauuucuauuaaagguuccuuuguucccuaaguccaacuacuaaacugggggauauuaugaagggccuugagcaucuggauucugccuaauaaaaaacauuuauuuucauugc

SEQ ID NO: 5026 - DNA, 44 bp, Artificial Sequence
  Center, alpha-complex-binding portion of the 3UTR of an alpha-globin gene (muag)
gcccgatgggcctcccaacgggccctcctcccctccttgcaccg

SEQ ID NO: 5027 - RNA, 44 nt, Artificial Sequence
  Center, alpha-complex-binding portion of the 3UTR of an alpha-globin gene (muag) mRNA
gcccgaugggccucccaacgggcccuccuccccuccuugcaccg

SEQ ID NO: 5028 - DNA, 186 bp, Artificial Sequence
  3-UTR of human albumin
catcacatttaaaagcatctcagcctaccatgagaataagagaaagaaaatgaagatcaaaagcttattcatctgtttttctttttcgttggtgtaaagccaacaccctgtctaaaaaacataaatttctttaatcattttgcctcttttctctgtgcttcaattaataaaaaatggaaagaatct

SEQ ID NO: 5029 - RNA, 186 nt, Artificial Sequence
  3-UTR of human albumin mRNA
caucacauuuaaaagcaucucagccuaccaugagaauaagagaaagaaaaugaagaucaaaagcuuauucaucuguuuuucuuuuucguugguguaaagccaacacccugucuaaaaaacauaaauuucuuuaaucauuuugccucuuuucucugugcuucaauuaauaaaaaauggaaagaaucu

SEQ ID NO: 5030 - DNA, 186 bp, Artificial Sequence
  3-UTR albumin7
catcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 5031 - RNA, 186 nt, Artificial Sequence
  3-UTR albumin7 mRNA
caucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 5032 - DNA, 187 bp, Artificial Sequence
  3-UTR ALB7
gcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacct

SEQ ID NO: 5033 - RNA, 187 nt, Artificial Sequence
  3-UTR ALB7 mRNA
gcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccu

SEQ ID NO: 5034 - DNA, 24 bp, Artificial Sequence
  histone stem-loop sequence
caaaggctcttttcagagccacca

SEQ ID NO: 5035 - RNA, 24 nt, Artificial Sequence
  histone stem-loop sequence mRNA
caaaggcucuuuucagagccacca

SEQ ID NO: 5036 - DNA, 13 bp, Artificial Sequence
  Kozak
gccgccaccatgg

SEQ ID NO: 5037 - RNA, 13 nt, Artificial Sequence
  Kozak mRNA
gccgccaccaugg

SEQ ID NO: 5038 - protein, 21 aa, Artificial Sequence
  derived and/or modified protein sequence (wt) from Homo sapiens__AAA61213.1__signal peptide-HsPLAT
MDAMKRGLCCVLLLCGAVFVS

SEQ ID NO: 5039 - protein, 22 aa, Artificial Sequence
  derived and/or modified protein sequence (wt) from Homo sapiens__AAA61213.1__signal peptide-HsPLAT
MDAMKRGLCCVLLLCGAVFVSP

SEQ ID NO: 5040 - protein, 18 aa, Artificial Sequence
  derived and/or modified protein sequence (wt) from Homo sapiens__AAB59424.1__signal peptide-IgE
MDWTWILFLVAAATRVHS

SEQ ID NO: 5041 - protein, 24 aa, Artificial Sequence
  derived and/or modified protein sequence (wt) from Homo sapiens__NP_055022.2__signal peptide-HsCD5
MPMGSLQPLATLYLLGMLVASCLG

SEQ ID NO: 5042 - protein, 20 aa, Artificial Sequence
  derived and/or modified protein sequence (wt) from Homo sapiens__NP_000577.2__signal peptide-HsIL2
MYRMQLLSCIALSLALVTNS

SEQ ID NO: 5043 - protein, 18 aa, Artificial Sequence
  derived and/or modified protein sequence (wt) from Homo sapiens__NP_001020371.3 __signal peptide-HsCTRB2
MAFLWLLSCWALLGTTFG

SEQ ID NO: 5044 - protein, 19 aa, Artificial Sequence
  derived and/or modified protein sequence (wt) from Homo sapiens__BAC87457.1__signal peptide-immunoglobulin (IgG heavy chain)
MEFGLSWVFLVALFRGVQC

SEQ ID NO: 5045 - protein, 19 aa, Artificial Sequence
  derived and/or modified protein sequence (wt) from Homo sapiens__AAA52897.1__signal peptide-human immunoglobulin heavy chain
MDWTWRVFCLLAVTPGAHP

SEQ ID NO: 5046 - protein, 19 aa, Artificial Sequence
  derived and/or modified protein sequence (wt) from Homo sapiens__AAA59018.1__signal peptide-human immunoglobulin light chain
MAWSPLFLTLITHCAGSWA

SEQ ID NO: 5047 - protein, 17 aa, Artificial Sequence
  derived and/or modified protein sequence (wt) from Gaussia princeps__AAG54095.1__signal peptide-GpLuc
MGVKVLFALICIAVAEA

SEQ ID NO: 5048 - protein, 21 aa, Artificial Sequence
  derived and/or modified protein sequence (wt) from Mus musculus__BAR42292.1__signal peptide-MmIgkappa
METDTLLLWVLLLWVPGSTGD

SEQ ID NO: 5049 - RNA, 63 nt, Artificial Sequence
  derived and/or modified CDS sequence (wt) from Homo sapiens__AAA61213.1__signal peptide-HsPLAT
auggaugcaaugaagagagggcucugcugugugcugcugcuguguggagcagucuucguuucg

SEQ ID NO: 5050 - RNA, 66 nt, Artificial Sequence
  derived and/or modified CDS sequence (wt) from Homo sapiens__AAA61213.1__signal peptide-HsPLAT
auggaugcaaugaagagagggcucugcugugugcugcugcuguguggagcagucuucguuucgccc

SEQ ID NO: 5051 - RNA, 54 nt, Artificial Sequence
  derived and/or modified CDS sequence (wt) from Homo sapiens__AAB59424.1__signal peptide-IgE
auggacuggaccuggauccuguuccucguggccgccgcgacccgcguccacagc

SEQ ID NO: 5052 - RNA, 72 nt, Artificial Sequence
  derived and/or modified CDS sequence (wt) from Homo sapiens__NP_055022.2__signal peptide-HsCD5
augcccauggggucucugcaaccgcuggccaccuuguaccugcuggggaugcuggucgcuuccugccucgga

SEQ ID NO: 5053 - RNA, 60 nt, Artificial Sequence
  derived and/or modified CDS sequence (wt) from Homo sapiens__NP_000577.2__signal peptide-HsIL2
auguacaggaugcaacuccugucuugcauugcacuaagucuugcacuugucacaaacagu

SEQ ID NO: 5054 - RNA, 54 nt, Artificial Sequence
  derived and/or modified CDS sequence (wt) from Homo sapiens__NP_001020371.3 __signal peptide-HsCTRB2
auggcuuuccucuggcuccucuccugcugggcccuccuggguaccaccuucggc

SEQ ID NO: 5055 - RNA, 57 nt, Artificial Sequence
  derived and/or modified CDS sequence (wt) from Homo sapiens__BAC87457.1__signal peptide-immunoglobulin (IgG heavy chain)
auggaguuugggcugagcuggguuuuccucguugcucuuuuuagagguguccagugu

SEQ ID NO: 5056 - RNA, 57 nt, Artificial Sequence
  derived and/or modified CDS sequence (wt) from Homo sapiens__AAA52897.1__signal peptide-human immunoglobulin heavy chain
auggacuggaccuggagggucuucuguuugcuggcuguaacuccaggcgcccacccc

SEQ ID NO: 5057 - RNA, 57 nt, Artificial Sequence
  derived and/or modified CDS sequence (wt) from Homo sapiens__AAA59018.1__signal peptide-human immunoglobulin light chain
auggccugguccccucucuuccucacccucaucacucacugugcaggguccugggcc

SEQ ID NO: 5058 - RNA, 51 nt, Artificial Sequence
  derived and/or modified CDS sequence (wt) from Gaussia princeps__AAG54095.1__signal peptide-GpLuc
augggagucaaaguucuguuugcccugaucugcaucgcuguggccgaggcc

SEQ ID NO: 5059 - RNA, 63 nt, Artificial Sequence
  derived and/or modified CDS sequence (wt) from Mus musculus__BAR42292.1__signal peptide-MmIgkappa
auggagacagacacacuccugcuaugggugcugcugcucuggguuccagguuccacaggugac

SEQ ID NO: 5060 - RNA, 63 nt, Artificial Sequence
  derived and/or modified CDS sequence (opt1) from Homo sapiens__AAA61213.1__signal peptide-HsPLAT
auggacgccaugaagcgcggccugugcugcgugcuccugcugugcggggccgucuucgugagc

SEQ ID NO: 5061 - RNA, 66 nt, Artificial Sequence
  derived and/or modified CDS sequence (opt1) from Homo sapiens__AAA61213.1__signal peptide-HsPLAT
auggacgccaugaagcgcggccugugcugcgugcuccugcugugcggggccgucuucgugagcccc

SEQ ID NO: 5062 - RNA, 54 nt, Artificial Sequence; identical to SEQ ID NO: 5051
  derived and/or modified CDS sequence (opt1) from Homo sapiens__AAB59424.1__signal peptide-IgE

SEQ ID NO: 5063 - RNA, 72 nt, Artificial Sequence
  derived and/or modified CDS sequence (opt1) from Homo sapiens__NP_055022.2__signal peptide-HsCD5
augcccaugggcagccugcagccgcucgccacccuguaccugcucgggaugcugguggccuccugccugggc

SEQ ID NO: 5064 - RNA, 60 nt, Artificial Sequence
  derived and/or modified CDS sequence (opt1) from Homo sapiens__NP_000577.2__signal peptide-HsIL2
auguaccggaugcagcugcucagcugcaucgcccugucgcuggcgcucgugaccaacagc

SEQ ID NO: 5065 - RNA, 54 nt, Artificial Sequence
  derived and/or modified CDS sequence (opt1) from Homo sapiens__NP_001020371.3 __signal peptide-HsCTRB2
auggccuuccuguggcuccugagcugcugggcccugcucggcaccaccuucggg

SEQ ID NO: 5066 - RNA, 57 nt, Artificial Sequence
  derived and/or modified CDS sequence (opt1) from Homo sapiens__BAC87457.1__signal peptide-immunoglobulin (IgG heavy chain)
auggaguucggccugagcuggguguuccucgucgcccuguuccgcggggugcagugc

SEQ ID NO: 5067 - RNA, 57 nt, Artificial Sequence
  derived and/or modified CDS sequence (opt1) from Homo sapiens__AAA52897.1__signal peptide-human immunoglobulin heavy chain
auggacuggaccuggcgcguguucugccugcucgccgucacccccggcgcccacccg

SEQ ID NO: 5068 - RNA, 57 nt, Artificial Sequence
  derived and/or modified CDS sequence (opt1) from Homo sapiens__AAA59018.1__signal peptide-human immunoglobulin light chain
auggccuggagcccccuguuccucacccugaucacccacugcgccggcuccugggcg

SEQ ID NO: 5069 - RNA, 51 nt, Artificial Sequence
  derived and/or modified CDS sequence (opt1) from Gaussia princeps__AAG54095.1__signal peptide-GpLuc
augggcgugaagguccuguucgcccucaucugcaucgccguggcggaggcc

SEQ ID NO: 5070 - RNA, 63 nt, Artificial Sequence
  derived and/or modified CDS sequence (opt1) from Mus musculus__BAR42292.1__signal peptide-MmIgkappa
auggagaccgacacccugcuccugugggugcugcuccuguggguccccggcagcacgggggac

SEQ ID NO: 5071 - RNA, 63 nt, Artificial Sequence
  derived and/or modified CDS sequence (opt2) from Homo sapiens__AAA61213.1__signal peptide-HsPLAT
auggacgccaugaagcgcggccucugcugcguccuccuccucugcggcgccgucuucgucucc

SEQ ID NO: 5072 - RNA, 66 nt, Artificial Sequence
  derived and/or modified CDS sequence (opt2) from Homo sapiens__AAA61213.1__signal peptide-HsPLAT
auggacgccaugaagcgcggccucugcugcguccuccuccucugcggcgccgucuucgucuccccc

SEQ ID NO: 5073 - RNA, 54 nt, Artificial Sequence
  derived and/or modified CDS sequence (opt2) from Homo sapiens__AAB59424.1__signal peptide-IgE
auggacuggaccuggauccucuuccucgucgccgccgccacccgcguccacucc

SEQ ID NO: 5074 - RNA, 72 nt, Artificial Sequence
  derived and/or modified CDS sequence (opt2) from Homo sapiens__NP_055022.2__signal peptide-HsCD5
augcccaugggcucccuccagccccucgccacccucuaccuccucggcaugcucgucgccuccugccucggc

SEQ ID NO: 5075 - RNA, 60 nt, Artificial Sequence
  derived and/or modified CDS sequence (opt2) from Homo sapiens__NP_000577.2__signal peptide-HsIL2
auguaccgcaugcagcuccucuccugcaucgcccucucccucgcccucgucaccaacucc

SEQ ID NO: 5076 - RNA, 54 nt, Artificial Sequence
  derived and/or modified CDS sequence (opt2) from Homo sapiens__NP_001020371.3 __signal peptide-HsCTRB2
auggccuuccucuggcuccucuccugcugggcccuccucggcaccaccuucggc

SEQ ID NO: 5077 - RNA, 57 nt, Artificial Sequence
  derived and/or modified CDS sequence (opt2) from Homo sapiens__BAC87457.1__signal peptide-immunoglobulin (IgG heavy chain)
auggaguucggccucuccugggucuuccucgucgcccucuuccgcggcguccagugc

SEQ ID NO: 5078 - RNA, 57 nt, Artificial Sequence
  derived and/or modified CDS sequence (opt2) from Homo sapiens__AAA52897.1__signal peptide-human immunoglobulin heavy chain
auggacuggaccuggcgcgucuucugccuccucgccgucacccccggcgcccacccc

SEQ ID NO: 5079 - RNA, 57 nt, Artificial Sequence
  derived and/or modified CDS sequence (opt2) from Homo sapiens__AAA59018.1__signal peptide-human immunoglobulin light chain
auggccugguccccccucuuccucacccucaucacccacugcgccggcuccugggcc

SEQ ID NO: 5080 - RNA, 51 nt, Artificial Sequence
  derived and/or modified CDS sequence (opt2) from Gaussia princeps__AAG54095.1__signal peptide-GpLuc
augggcgucaagguccucuucgcccucaucugcaucgccgucgccgaggcc

SEQ ID NO: 5081 - RNA, 63 nt, Artificial Sequence
  derived and/or modified CDS sequence (opt2) from Mus musculus__BAR42292.1__signal peptide-MmIgkappa
auggagaccgacacccuccuccucuggguccuccuccucuggguccccggcuccaccggcgac

SEQ ID NO: 5082 - RNA, 63 nt, Artificial Sequence
  derived and/or modified CDS sequence (opt3) from Homo sapiens__AAA61213.1__signal peptide-HsPLAT
auggacgccaugaagagaggccugugcugugugcuccuucugugcggggcugucuucguuagc

SEQ ID NO: 5083 - RNA, 66 nt, Artificial Sequence
  derived and/or modified CDS sequence (opt3) from Homo sapiens__AAA61213.1__signal peptide-HsPLAT
auggacgccaugaagagaggccugugcugugugcuccuucugugcggggcugucuucguuagcccc

SEQ ID NO: 5084 - RNA, 54 nt, Artificial Sequence
  derived and/or modified CDS sequence (opt3) from Homo sapiens__AAB59424.1__signal peptide-IgE
auggacuggaccuggauccuguuccucguggccgcugcaacaagaguccacagc

SEQ ID NO: 5085 - RNA, 72 nt, Artificial Sequence
  derived and/or modified CDS sequence (opt3) from Homo sapiens__NP_055022.2__signal peptide-HsCD5
augcccaugggcagccugcagccucucgccacccuuuaccuguuggggauguuaguggcuuccugccuggga

SEQ ID NO: 5086 - RNA, 60 nt, Artificial Sequence
  derived and/or modified CDS sequence (opt3) from Homo sapiens__NP_000577.2__signal peptide-HsIL2
auguacagaaugcagcugcucagcugcaucgcccuuucccuggcuuuggugaccaacucu

SEQ ID NO: 5087 - RNA, 54 nt, Artificial Sequence
  derived and/or modified CDS sequence (opt3) from Homo sapiens__NP_001020371.3 __signal peptide-HsCTRB2
auggccuuccuguggcuccuuagcugcugggcucuguugggcaccacauuuggg

SEQ ID NO: 5088 - RNA, 57 nt, Artificial Sequence
  derived and/or modified CDS sequence (opt3) from Homo sapiens__BAC87457.1__signal peptide-immunoglobulin (IgG heavy chain)
auggaguucggccugagcuggguguuucucgucgcccuuuucagagggguucagugc

SEQ ID NO: 5089 - RNA, 57 nt, Artificial Sequence
  derived and/or modified CDS sequence (opt3) from Homo sapiens__AAA52897.1__signal peptide-human immunoglobulin heavy chain
auggacuggaccuggagaguguucugccugcucgccgucacacccggcgcucacccu

SEQ ID NO: 5090 - RNA, 57 nt, Artificial Sequence
  derived and/or modified CDS sequence (opt3) from Homo sapiens__AAA59018.1__signal peptide-human immunoglobulin light chain
auggccuggagcccccuguuccucacccuuaucacacacugcgcuggcuccugggca

SEQ ID NO: 5091 - RNA, 51 nt, Artificial Sequence
  derived and/or modified CDS sequence (opt3) from Gaussia princeps__AAG54095.1__signal peptide-GpLuc
augggcgugaagguccuguucgcccucaucugcauugcuguugcagaggcc

SEQ ID NO: 5092 - RNA, 63 nt, Artificial Sequence
  derived and/or modified CDS sequence (opt3) from Mus musculus__BAR42292.1__signal peptide-MmIgkappa
auggagaccgacacacugcuccuuugggugcuguuguuauggguccccggcagcacuggggau

SEQ ID NO: 5093 - RNA, 63 nt, Artificial Sequence
  derived and/or modified CDS sequence (opt4) from Homo sapiens__AAA61213.1__signal peptide-HsPLAT
auggacgccaugaagagaggccugugcugcgugcugcugcugugcggcgccguguucgugagc

SEQ ID NO: 5094 - RNA, 66 nt, Artificial Sequence
  derived and/or modified CDS sequence (opt4) from Homo sapiens__AAA61213.1__signal peptide-HsPLAT
auggacgccaugaagagaggccugugcugcgugcugcugcugugcggcgccguguucgugagcccc

SEQ ID NO: 5095 - RNA, 54 nt, Artificial Sequence
  derived and/or modified CDS sequence (opt4) from Homo sapiens__AAB59424.1__signal peptide-IgE
auggacuggaccuggauccuguuccugguggccgccgccaccagagugcacagc

SEQ ID NO: 5096 - RNA, 72 nt, Artificial Sequence
  derived and/or modified CDS sequence (opt4) from Homo sapiens__NP_055022.2__signal peptide-HsCD5
augcccaugggcagccugcagccccuggccacccuguaccugcugggcaugcugguggccagcugccugggc

SEQ ID NO: 5097 - RNA, 60 nt, Artificial Sequence
  derived and/or modified CDS sequence (opt4) from Homo sapiens__NP_000577.2__signal peptide-HsIL2
auguacagaaugcagcugcugagcugcaucgcccugagccuggcccuggugaccaacagc

SEQ ID NO: 5098 - RNA, 54 nt, Artificial Sequence
  derived and/or modified CDS sequence (opt4) from Homo sapiens__NP_001020371.3 __signal peptide-HsCTRB2
auggccuuccuguggcugcugagcugcugggcccugcugggcaccaccuucggc

SEQ ID NO: 5099 - RNA, 57 nt, Artificial Sequence
  derived and/or modified CDS sequence (opt4) from Homo sapiens__BAC87457.1__signal peptide-immunoglobulin (IgG heavy chain)
auggaguucggccugagcuggguguuccugguggcccuguucagaggcgugcagugc

SEQ ID NO: 5100 - RNA, 57 nt, Artificial Sequence
  derived and/or modified CDS sequence (opt4) from Homo sapiens__AAA52897.1__signal peptide-human immunoglobulin heavy chain
auggacuggaccuggagaguguucugccugcuggccgugacccccggcgcccacccc

SEQ ID NO: 5101 - RNA, 57 nt, Artificial Sequence
  derived and/or modified CDS sequence (opt4) from Homo sapiens__AAA59018.1__signal peptide-human immunoglobulin light chain
auggccuggagcccccuguuccugacccugaucacccacugcgccggcagcugggcc

SEQ ID NO: 5102 - RNA, 51 nt, Artificial Sequence
  derived and/or modified CDS sequence (opt4) from Gaussia princeps__AAG54095.1__signal peptide-GpLuc
augggcgugaaggugcuguucgcccugaucugcaucgccguggccgaggcc

SEQ ID NO: 5103 - RNA, 63 nt, Artificial Sequence
  derived and/or modified CDS sequence (opt4) from Mus musculus__BAR42292.1__signal peptide-MmIgkappa
auggagaccgacacccugcugcugugggugcugcugcugugggugcccggcagcaccggcgac

SEQ ID NO: 5104 - RNA, 63 nt, Artificial Sequence
  derived and/or modified CDS sequence (opt5) from Homo sapiens__AAA61213.1__signal peptide-HsPLAT
auggacgccaugaagagaggccugugcugugugcuccugcuuugcggggcugucuucguuagc

SEQ ID NO: 5105 - RNA, 66 nt, Artificial Sequence
  derived and/or modified CDS sequence (opt5) from Homo sapiens__AAA61213.1__signal peptide-HsPLAT
auggacgccaugaagagaggccugugcugugugcuccugcuuugcggggcugucuucguuagcccc

SEQ ID NO: 5106 - RNA, 54 nt, Artificial Sequence
  derived and/or modified CDS sequence (opt5) from Homo sapiens__AAB59424.1__signal peptide-IgE
auggacuggaccuggauccuguuccucguggccgcugccacaagaguccacagc

SEQ ID NO: 5107 - RNA, 72 nt, Artificial Sequence
  derived and/or modified CDS sequence (opt5) from Homo sapiens__NP_055022.2__signal peptide-HsCD5
augcccaugggcagccugcagccucucgccacccuguaccuucuggggaugcucguggcuuccugccuggga

SEQ ID NO: 5108 - RNA, 60 nt, Artificial Sequence
  derived and/or modified CDS sequence (opt5) from Homo sapiens__NP_000577.2__signal peptide-HsIL2
auguacagaaugcagcugcucagcugcaucgcccugucccuugcucuggugaccaacucu

SEQ ID NO: 5109 - RNA, 54 nt, Artificial Sequence
  derived and/or modified CDS sequence (opt5) from Homo sapiens__NP_001020371.3 __signal peptide-HsCTRB2
auggcuuuccuguggcuccugagcugcugggcccuucugggcaccacauuuggg

SEQ ID NO: 5110 - RNA, 57 nt, Artificial Sequence
  derived and/or modified CDS sequence (opt5) from Homo sapiens__BAC87457.1__signal peptide-immunoglobulin (IgG heavy chain)
auggaguucggccugagcuggguguuucucgucgcccuguucagagggguucagugc

SEQ ID NO: 5111 - RNA, 57 nt, Artificial Sequence; identical to SEQ ID NO: 5089
  derived and/or modified CDS sequence (opt5) from Homo sapiens__AAA52897.1__signal peptide-human immunoglobulin heavy chain

SEQ ID NO: 5112 - RNA, 57 nt, Artificial Sequence
  derived and/or modified CDS sequence (opt5) from Homo sapiens__AAA59018.1__signal peptide-human immunoglobulin light chain
auggccuggagcccccuguuccucacccugaucacacacugcgcuggcuccugggcc

SEQ ID NO: 5113 - RNA, 51 nt, Artificial Sequence
  derived and/or modified CDS sequence (opt5) from Gaussia princeps__AAG54095.1__signal peptide-GpLuc
augggcgugaagguccuguucgcccucaucugcauugcuguugccgaggcg

SEQ ID NO: 5114 - RNA, 63 nt, Artificial Sequence
  derived and/or modified CDS sequence (opt5) from Mus musculus__BAR42292.1__signal peptide-MmIgkappa
auggagaccgacacacugcuccugugggugcuucugcucuggguccccggcagcacgggggau

SEQ ID NO: 5115 - RNA, 63 nt, Artificial Sequence
  derived and/or modified CDS sequence (opt6) from Homo sapiens__AAA61213.1__signal peptide-HsPLAT
auggaugcgaugaagagaggguuauguuguguguuauuguuauguggagcgguauuuguaagu

SEQ ID NO: 5116 - RNA, 66 nt, Artificial Sequence
  derived and/or modified CDS sequence (opt6) from Homo sapiens__AAA61213.1__signal peptide-HsPLAT
auggaugcaaugaaaagaggauuauguuguguauuauuauuauguggagcaguauuuguaagucca

SEQ ID NO: 5117 - RNA, 54 nt, Artificial Sequence
  derived and/or modified CDS sequence (opt6) from Homo sapiens__AAB59424.1__signal peptide-IgE
auggacuggacauggauauuauuuuuaguagcagcagcaacaagaguacauuca

SEQ ID NO: 5118 - RNA, 72 nt, Artificial Sequence
  derived and/or modified CDS sequence (opt6) from Homo sapiens__NP_055022.2__signal peptide-HsCD5
augccuauggguucacuucaaccuuuagcuacacuuuaucuuuuagguaugcuuguagcuucauguuuaggu

SEQ ID NO: 5119 - RNA, 60 nt, Artificial Sequence
  derived and/or modified CDS sequence (opt6) from Homo sapiens__NP_000577.2__signal peptide-HsIL2
auguaccguaugcaacuacuuucauguauagcucuaucucuagcucuaguuacaaauuca

SEQ ID NO: 5120 - RNA, 54 nt, Artificial Sequence
  derived and/or modified CDS sequence (opt6) from Homo sapiens__NP_001020371.3 __signal peptide-HsCTRB2
auggcuuuuuuaugguuauuaucuuguugggcuuuauuagguacuacuuuuggu

SEQ ID NO: 5121 - RNA, 57 nt, Artificial Sequence
  derived and/or modified CDS sequence (opt6) from Homo sapiens__BAC87457.1__signal peptide-immunoglobulin (IgG heavy chain)
auggaauuugguuuaucuuggguuuuuuuaguugcuuuauuuagagguguucagugu

SEQ ID NO: 5122 - RNA, 57 nt, Artificial Sequence
  derived and/or modified CDS sequence (opt6) from Homo sapiens__AAA52897.1__signal peptide-human immunoglobulin heavy chain
auggauuggacuuggcguguauuuuguuuauuagcuguaacuccaggugcacaucca

SEQ ID NO: 5123 - RNA, 57 nt, Artificial Sequence
  derived and/or modified CDS sequence (opt6) from Homo sapiens__AAA59018.1__signal peptide-human immunoglobulin light chain
auggccuggaguccauuauuuuuaacauuaauaacucauugugcaggcucaugggca

SEQ ID NO: 5124 - RNA, 51 nt, Artificial Sequence
  derived and/or modified CDS sequence (opt6) from Gaussia princeps__AAG54095.1__signal peptide-GpLuc
augggaguaaaaguacuauuugcauuaauauguauagcaguagcagaagca

SEQ ID NO: 5125 - RNA, 63 nt, Artificial Sequence
  derived and/or modified CDS sequence (opt6) from Mus musculus__BAR42292.1__signal peptide-MmIgkappa
auggaaacagauacauuauuauuauggguuuuauuauuauggguaccuggaaguacaggugac

SEQ ID NO: 5126 - RNA, 63 nt, Artificial Sequence
  derived and/or modified CDS sequence (opt7) from Homo sapiens__AAA61213.1__signal peptide-HsPLAT
auggacgccaugaagaggggccugugcugugugcuccuguugugcggggcagucuucgugagc

SEQ ID NO: 5127 - RNA, 66 nt, Artificial Sequence
  derived and/or modified CDS sequence (opt7) from Homo sapiens__AAA61213.1__signal peptide-HsPLAT
auggacgccaugaagaggggccugugcugugugcuccuguugugcggggcagucuucgugagcccc

SEQ ID NO: 5128 - RNA, 54 nt, Artificial Sequence
  derived and/or modified CDS sequence (opt7) from Homo sapiens__AAB59424.1__signal peptide-IgE
auggacuggaccuggauccuguuccucguggccgcagccacuaggguccacagc

SEQ ID NO: 5129 - RNA, 72 nt, Artificial Sequence
  derived and/or modified CDS sequence (opt7) from Homo sapiens__NP_055022.2__signal peptide-HsCD5
augcccaugggcagccugcagccacucgccacccuguacuugcuggggaugcucguggcauccugccugggu

SEQ ID NO: 5130 - RNA, 60 nt, Artificial Sequence
  derived and/or modified CDS sequence (opt7) from Homo sapiens__NP_000577.2__signal peptide-HsIL2
auguacaggaugcagcugcucagcugcaucgcccuguccuuggcacuggugaccaacagu

SEQ ID NO: 5131 - RNA, 54 nt, Artificial Sequence
  derived and/or modified CDS sequence (opt7) from Homo sapiens__NP_001020371.3 __signal peptide-HsCTRB2
auggccuuccuguggcuccugagcugcugggcauugcugggcaccacuuuuggg

SEQ ID NO: 5132 - RNA, 57 nt, Artificial Sequence
  derived and/or modified CDS sequence (opt7) from Homo sapiens__BAC87457.1__signal peptide-immunoglobulin (IgG heavy chain)
auggaguucgggcugagcuggguguuucucgucgcccuguucaggggcgugcagugc

SEQ ID NO: 5133 - RNA, 57 nt, Artificial Sequence
  derived and/or modified CDS sequence (opt7) from Homo sapiens__AAA52897.1__signal peptide-human immunoglobulin heavy chain
auggacuggaccuggaggguguucugccugcucgccgucacucccggcgcacaccca

SEQ ID NO: 5134 - RNA, 57 nt, Artificial Sequence
  derived and/or modified CDS sequence (opt7) from Homo sapiens__AAA59018.1__signal peptide-human immunoglobulin light chain
auggccuggagcccccuguuccucacccugaucacucacugcgcaggcuccugggcc

SEQ ID NO: 5135 - RNA, 51 nt, Artificial Sequence
  derived and/or modified CDS sequence (opt7) from Gaussia princeps__AAG54095.1__signal peptide-GpLuc
augggcgugaagguccuguucgcccucaucugcauugcaguggccgaggcg

SEQ ID NO: 5136 - RNA, 63 nt, Artificial Sequence
  derived and/or modified CDS sequence (opt7) from Mus musculus__BAR42292.1__signal peptide-MmIgkappa
auggagaccgacacucugcuccuguggguguugcugcucuggguccccggcagcaccggggau

SEQ ID NO: 5137 - RNA, 63 nt, Artificial Sequence
  derived and/or modified CDS sequence (opt8) from Homo sapiens__AAA61213.1__signal peptide-HsPLAT
auggaugcgaugaagaggggguuguguuguguguuguuguuguguggggcgguguuugugagu

SEQ ID NO: 5138 - RNA, 66 nt, Artificial Sequence
  derived and/or modified CDS sequence (opt8) from Homo sapiens__AAA61213.1__signal peptide-HsPLAT
auggacgcgaugaagagagggcucuguugcgugcuauugcucuguggcgcggucuuugucucgccc

SEQ ID NO: 5139 - RNA, 54 nt, Artificial Sequence
  derived and/or modified CDS sequence (opt8) from Homo sapiens__AAB59424.1__signal peptide-IgE
auggacuggacguggauacucuuucucguagccgcggccacgcgcgugcacuca

SEQ ID NO: 5140 - RNA, 72 nt, Artificial Sequence
  derived and/or modified CDS sequence (opt8) from Homo sapiens__NP_055022.2__signal peptide-HsCD5
augcccaugggcucacuccaaccccuagccacccucuaccuccucggcaugcucgucgccucaugccucggc

SEQ ID NO: 5141 - RNA, 60 nt, Artificial Sequence
  derived and/or modified CDS sequence (opt8) from Homo sapiens__NP_000577.2__signal peptide-HsIL2
auguaccgcaugcaauuacucuccugcaucgcccuaucccucgcccuagucaccaacucc

SEQ ID NO: 5142 - RNA, 54 nt, Artificial Sequence
  derived and/or modified CDS sequence (opt8) from Homo sapiens__NP_001020371.3 __signal peptide-HsCTRB2
auggccuuccuuuggcucuuauccugcugggcucuccucggcaccaccuucggc

SEQ ID NO: 5143 - RNA, 57 nt, Artificial Sequence
  derived and/or modified CDS sequence (opt8) from Homo sapiens__BAC87457.1__signal peptide-immunoglobulin (IgG heavy chain)
auggaguucgggcucucauggguguucuuggucgcacucuuucgcgggguccagugc

SEQ ID NO: 5144 - RNA, 57 nt, Artificial Sequence
  derived and/or modified CDS sequence (opt8) from Homo sapiens__AAA52897.1__signal peptide-human immunoglobulin heavy chain
auggacuggaccuggcgcguauucugccuacuagccguaacccccggcgcccaccca

SEQ ID NO: 5145 - RNA, 57 nt, Artificial Sequence
  derived and/or modified CDS sequence (opt8) from Homo sapiens__AAA59018.1__signal peptide-human immunoglobulin light chain
auggccugguccccacucuuccucacacucaucacccacugcgccggcuccugggcc

SEQ ID NO: 5146 - RNA, 51 nt, Artificial Sequence
  derived and/or modified CDS sequence (opt8) from Gaussia princeps__AAG54095.1__signal peptide-GpLuc
augggggugaaggugcuguuugcguugauauguauagcgguggcggaggcg

SEQ ID NO: 5147 - RNA, 63 nt, Artificial Sequence
  derived and/or modified CDS sequence (opt8) from Mus musculus__BAR42292.1__signal peptide-MmIgkappa
auggaaaccgacacacuccuacucuggguccuccuccucuggguccccggcuccaccggcgac

SEQ ID NO: 5148 - RNA, 63 nt, Artificial Sequence; identical to SEQ ID NO: 5137
  derived and/or modified CDS sequence (opt9) from Homo sapiens__AAA61213.1__signal peptide-HsPLAT

SEQ ID NO: 5149 - RNA, 66 nt, Artificial Sequence
  derived and/or modified CDS sequence (opt9) from Homo sapiens__AAA61213.1__signal peptide-HsPLAT
auggacgccaugaaacgaggccucugcugcguccuacuccucugcggcgccguauucgucuccccc

SEQ ID NO: 5150 - RNA, 54 nt, Artificial Sequence
  derived and/or modified CDS sequence (opt9) from Homo sapiens__AAB59424.1__signal peptide-IgE
auggacuggaccuggauacucuuucucgucgccgccgccacccgcguccacuca

SEQ ID NO: 5151 - RNA, 72 nt, Artificial Sequence
  derived and/or modified CDS sequence (opt9) from Homo sapiens__NP_055022.2__signal peptide-HsCD5
augcccaugggcucccuccaaccccuagccacacucuaccuccucggcaugcucgucgccuccugccuaggc

SEQ ID NO: 5152 - RNA, 60 nt, Artificial Sequence
  derived and/or modified CDS sequence (opt9) from Homo sapiens__NP_000577.2__signal peptide-HsIL2
auguaccgcaugcaacuccuauccugcaucgcccucucacucgcccucguaaccaacucc

SEQ ID NO: 5153 - RNA, 54 nt, Artificial Sequence
  derived and/or modified CDS sequence (opt9) from Homo sapiens__NP_001020371.3 __signal peptide-HsCTRB2
auggccuuccucuggcuccucucauguugggcccuacucggcaccaccuucgga

SEQ ID NO: 5154 - RNA, 57 nt, Artificial Sequence
  derived and/or modified CDS sequence (opt9) from Homo sapiens__BAC87457.1__signal peptide-immunoglobulin (IgG heavy chain)
auggaguucgggcucucguggguguucuuggucgcgcucuuucgcgggguccagugc

SEQ ID NO: 5155 - RNA, 57 nt, Artificial Sequence
  derived and/or modified CDS sequence (opt9) from Homo sapiens__AAA52897.1__signal peptide-human immunoglobulin heavy chain
auggacuggaccuggcgcguauucugccuccuagccguaacccccggcgcccaccca

SEQ ID NO: 5156 - RNA, 57 nt, Artificial Sequence; identical to SEQ ID NO: 5145
  derived and/or modified CDS sequence (opt9) from Homo sapiens__AAA59018.1__signal peptide-human immunoglobulin light chain

SEQ ID NO: 5157 - RNA, 51 nt, Artificial Sequence; identical to SEQ ID NO: 5146
  derived and/or modified CDS sequence (opt9) from Gaussia princeps__AAG54095.1__signal peptide-GpLuc

SEQ ID NO: 5158 - RNA, 63 nt, Artificial Sequence; identical to SEQ ID NO: 5147
  derived and/or modified CDS sequence (opt9) from Mus musculus__BAR42292.1__signal peptide-MmIgkappa

SEQ ID NO: 5159 - RNA, 63 nt, Artificial Sequence
  derived and/or modified CDS sequence (opt11) from Homo sapiens__AAA61213.1__signal peptide-HsPLAT
auggacgcgaugaagcgcgggcucuguugcgugcucuugcucuguggcgcggucuuugucucg

SEQ ID NO: 5160 - RNA, 66 nt, Artificial Sequence
  derived and/or modified CDS sequence (opt11) from Homo sapiens__AAA61213.1__signal peptide-HsPLAT
auggaugcgaugaagaggggguuguguuguguguuguuguuguguggggcgguguuugugaguccg

SEQ ID NO: 5161 - RNA, 54 nt, Artificial Sequence
  derived and/or modified CDS sequence (opt11) from Homo sapiens__AAB59424.1__signal peptide-IgE
auggauuggacguggauacucuuucucguggccgcggccacgcgcgugcacucg

SEQ ID NO: 5162 - RNA, 72 nt, Artificial Sequence
  derived and/or modified CDS sequence (opt11) from Homo sapiens__NP_055022.2__signal peptide-HsCD5
augcccaugggcucccuccaaccccucgccacccucuaccuccucggcaugcucgucgccuccugccucggc

SEQ ID NO: 5163 - RNA, 60 nt, Artificial Sequence
  derived and/or modified CDS sequence (opt11) from Homo sapiens__NP_000577.2__signal peptide-HsIL2
auguaccgcaugcaacuccucuccugcaucgcccucucccucgcccucgucaccaacucc

SEQ ID NO: 5164 - RNA, 54 nt, Artificial Sequence; identical to SEQ ID NO: 5076
  derived and/or modified CDS sequence (opt11) from Homo sapiens__NP_001020371.3 __signal peptide-HsCTRB2

SEQ ID NO: 5165 - RNA, 57 nt, Artificial Sequence; identical to SEQ ID NO: 5154
  derived and/or modified CDS sequence (opt11) from Homo sapiens__BAC87457.1__signal peptide-immunoglobulin (IgG heavy chain)

SEQ ID NO: 5166 - RNA, 57 nt, Artificial Sequence
  derived and/or modified CDS sequence (opt11) from Homo sapiens__AAA52897.1__signal peptide-human immunoglobulin heavy chain
auggacuggaccuggcgcguguucugucucuuggccgugaccccgggcgcgcacccg

SEQ ID NO: 5167 - RNA, 57 nt, Artificial Sequence; identical to SEQ ID NO: 5145
  derived and/or modified CDS sequence (opt11) from Homo sapiens__AAA59018.1__signal peptide-human immunoglobulin light chain

SEQ ID NO: 5168 - RNA, 51 nt, Artificial Sequence
  derived and/or modified CDS sequence (opt11) from Gaussia princeps__AAG54095.1__signal peptide-GpLuc
augggcgugaaagugcucuuugccuugaucuguaucgcggucgcggaagcg

SEQ ID NO: 5169 - RNA, 63 nt, Artificial Sequence; identical to SEQ ID NO: 5147
  derived and/or modified CDS sequence (opt11) from Mus musculus__BAR42292.1__signal peptide-MmIgkappa

SEQ ID NO: 5170 - RNA, 63 nt, Artificial Sequence; identical to SEQ ID NO: 5115
  derived and/or modified CDS sequence (opt12) from Homo sapiens__AAA61213.1__signal peptide-HsPLAT

SEQ ID NO: 5171 - RNA, 66 nt, Artificial Sequence; identical to SEQ ID NO: 5116
  derived and/or modified CDS sequence (opt12) from Homo sapiens__AAA61213.1__signal peptide-HsPLAT

SEQ ID NO: 5172 - RNA, 54 nt, Artificial Sequence; identical to SEQ ID NO: 5117
  derived and/or modified CDS sequence (opt12) from Homo sapiens__AAB59424.1__signal peptide-IgE

SEQ ID NO: 5173 - RNA, 72 nt, Artificial Sequence; identical to SEQ ID NO: 5118
  derived and/or modified CDS sequence (opt12) from Homo sapiens__NP_055022.2__signal peptide-HsCD5

SEQ ID NO: 5174 - RNA, 60 nt, Artificial Sequence
  derived and/or modified CDS sequence (opt12) from Homo sapiens__NP_000577.2__signal peptide-HsIL2
auguacagaaugcaacuacuaucaugcauagcacuaucacuagcucuaguaacaaacuca

SEQ ID NO: 5175 - RNA, 54 nt, Artificial Sequence
  derived and/or modified CDS sequence (opt12) from Homo sapiens__NP_001020371.3 __signal peptide-HsCTRB2
auggcauuuuuaugguuauuaucauguugggcuuuauuaggaacuacauuugga

SEQ ID NO: 5176 - RNA, 57 nt, Artificial Sequence
  derived and/or modified CDS sequence (opt12) from Homo sapiens__BAC87457.1__signal peptide-immunoglobulin (IgG heavy chain)
auggaauuuggauuaaguuggguauuuuuaguugcauuauuuagaggaguucagugu

SEQ ID NO: 5177 - RNA, 57 nt, Artificial Sequence
  derived and/or modified CDS sequence (opt12) from Homo sapiens__AAA52897.1__signal peptide-human immunoglobulin heavy chain
auggacuggacauggagaguauuuuguuuauuagcaguaacaccaggagcacaucca

SEQ ID NO: 5178 - RNA, 57 nt, Artificial Sequence; identical to SEQ ID NO: 5123
  derived and/or modified CDS sequence (opt12) from Homo sapiens__AAA59018.1__signal peptide-human immunoglobulin light chain

SEQ ID NO: 5179 - RNA, 51 nt, Artificial Sequence; identical to SEQ ID NO: 5124
  derived and/or modified CDS sequence (opt12) from Gaussia princeps__AAG54095.1__signal peptide-GpLuc

SEQ ID NO: 5180 - RNA, 63 nt, Artificial Sequence
  derived and/or modified CDS sequence (opt12) from Mus musculus__BAR42292.1__signal peptide-MmIgkappa
auggaaacagauacauuauuauuauggguauuauuauuauggguaccaggaaguacaggagac

SEQ ID NO: 5181 - RNA, 63 nt, Artificial Sequence
  derived and/or modified CDS sequence (opt13) from Homo sapiens__AAA61213.1__signal peptide-HsPLAT
auggaugcuaugaagagagguuuauguuguguuuuauuguuauguggagcuguauuuguaagu

SEQ ID NO: 5182 - RNA, 66 nt, Artificial Sequence; identical to SEQ ID NO: 5116
  derived and/or modified CDS sequence (opt13) from Homo sapiens__AAA61213.1__signal peptide-HsPLAT

SEQ ID NO: 5183 - RNA, 54 nt, Artificial Sequence; identical to SEQ ID NO: 5117
  derived and/or modified CDS sequence (opt13) from Homo sapiens__AAB59424.1__signal peptide-IgE

SEQ ID NO: 5184 - RNA, 72 nt, Artificial Sequence; identical to SEQ ID NO: 5118
  derived and/or modified CDS sequence (opt13) from Homo sapiens__NP_055022.2__signal peptide-HsCD5

SEQ ID NO: 5185 - RNA, 60 nt, Artificial Sequence; identical to SEQ ID NO: 5174
  derived and/or modified CDS sequence (opt13) from Homo sapiens__NP_000577.2__signal peptide-HsIL2

SEQ ID NO: 5186 - RNA, 54 nt, Artificial Sequence; identical to SEQ ID NO: 5120
  derived and/or modified CDS sequence (opt13) from Homo sapiens__NP_001020371.3 __signal peptide-HsCTRB2

SEQ ID NO: 5187 - RNA, 57 nt, Artificial Sequence; identical to SEQ ID NO: 5176
  derived and/or modified CDS sequence (opt13) from Homo sapiens__BAC87457.1__signal peptide-immunoglobulin (IgG heavy chain)

SEQ ID NO: 5188 - RNA, 57 nt, Artificial Sequence; identical to SEQ ID NO: 5177
  derived and/or modified CDS sequence (opt13) from Homo sapiens__AAA52897.1__signal peptide-human immunoglobulin heavy chain

SEQ ID NO: 5189 - RNA, 57 nt, Artificial Sequence; identical to SEQ ID NO: 5123
  derived and/or modified CDS sequence (opt13) from Homo sapiens__AAA59018.1__signal peptide-human immunoglobulin light chain

SEQ ID NO: 5190 - RNA, 51 nt, Artificial Sequence; identical to SEQ ID NO: 5124
  derived and/or modified CDS sequence (opt13) from Gaussia princeps__AAG54095.1__signal peptide-GpLuc

SEQ ID NO: 5191 - RNA, 63 nt, Artificial Sequence; identical to SEQ ID NO: 5180
  derived and/or modified CDS sequence (opt13) from Mus musculus__BAR42292.1__signal peptide-MmIgkappa

SEQ ID NO: 5192 - protein, 1008 aa, Artificial Sequence
  derived and/or modified protein sequence (wt) from Clostridium histolyticum__BAA77453.1__ColG(111-1118)
IANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 5193 - protein, 1124 aa, Artificial Sequence
  derived and/or modified protein sequence (wt) from Clostridium histolyticum__BAA77453.1__ColG(1-110)_CS-F_ColG(111-1118)
MKKNILKILMDSYSKESKIQTVRRVTSVSLLAVYLTMNTSSLVLAKPIENTNDTSIKNVEKLRNAPNEENSKKVEDSKNDKVEHVKNIEEAKVEQVAPEVKSKSTLRSASRRRRKRIANTNSEKYDFEYLNGLSYTELTNLIKNIKWNQINGLFNYSTGSQKFFGDKNRVQAIINALQESGRTYTANDMKGIETFTEVLRAGFYLGYYNDGLSYLNDRNFQDKCIPAMIAIQKNPNFKLGTAVQDEVITSLGKLIGNASANAEVVNNCVPVLKQFRENLNQYAPDYVKGTAVNELIKGIEFDFSGAAYEKDVKTMPWYGKIDPFINELKALGLYGNITSATEWASDVGIYYLSKFGLYSTNRNDIVQSLEKAVDMYKYGKIAFVAMERITWDYDGIGSNGKKVDHDKFLDDAEKHYLPKTYTFDNGTFIIRAGDKVSEEKIKRLYWASREVKSQFHRVVGNDKALEVGNADDVLTMKIFNSPEEYKFNTNINGVSTDNGGLYIEPRGTFYTYERTPQQSIFSLEELFRHEYTHYLQARYLVDGLWGQGPFYEKNRLTWFDEGTAEFFAGSTRTSGVLPRKSILGYLAKDKVDHRYSLKKTLNSGYDDSDWMFYNYGFAVAHYLYEKDMPTFIKMNKAILNTDVKSYDEIIKKLSDDANKNTEYQNHIQELADKYQGAGIPLVSDDYLKDHGYKKASEVYSEISKAASLTNTSVTAEKSQYFNTFTLRGTYTGETSKGEFKDWDEMSKKLDGTLESLAKNSWSGYKTLTAYFTNYRVTSDNKVQYDVVFHGVLTDNADISNNKAPIAKVTGPSTGAVGRNIEFSGKDSKDEDGKIVSYDWDFGDGATSRGKNSVHAYKKAGTYNVTLKVTDDKGATATESFTIEIKNEDTTTPITKEMEPNDDIKEANGPIVEGVTVKGDLNGSDDADTFYFDVKEDGDVTIELPYSGSSNFTWLVYKEGDDQNHIASGIDKNNSKVGTFKSTKGRHYVFIYKHDSASNISYSLNIKGLGNEKLKEKENNDSSDKATVIPNFNTTMQGSLLGDDSRDYYSFEVKEEGEVNIELDKKDEFGVTWTLHPESNINDRITYGQVDGNKVSNKVKLRPGKYYLLVYKYSGSGNYELRVNK

SEQ ID NO: 5194 - protein, 981 aa, Artificial Sequence
  derived and/or modified protein sequence (wt) from Clostridium histolyticum__BAA34542.1__ColH(41-1021)
VQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 5195 - protein, 1027 aa, Artificial Sequence
  derived and/or modified protein sequence (wt) from Clostridium histolyticum__BAA34542.1__ColH(1-40)_CS-F_ColH(41-1021)
MKRKCLSKRLMLAITMATIFTVNSTLPIYAAVDKNNATAARRRRKRVQNESKRYTVSYLKTLNYYDLVDLLVKTEIENLPDLFQYSSDAKEFYGNKTRMSFIMDEIGRRAPQYTEIDHKGIPTLVEVVRAGFYLGFHNKELNEINKRSFKERVIPSILAIQKNPNFKLGTEVQDKIVSATGLLAGNETAPPEVVNNFTPILQDCIKNIDRYALDDLKSKALFNVLAAPTYDITEYLRATKEKPENTPWYGKIDGFINELKKLALYGKINDNNSWIIDNGIYHIAPLGKLHSNNKIGIETLTEVMKVYPYLSMQHLQSADQIKRHYDSKDAEGNKIPLDKFKKEGKEKYCPKTYTFDDGKVIIKAGARVEEEKVKRLYWASKEVNSQFFRVYGIDKPLEEGNPDDILTMVIYNSPEEYKLNSVLYGYDTNNGGMYIEPEGTFFTYEREAQESTYTLEELFRHEYTHYLQGRYAVPGQWGRTKLYDNDRLTWYEEGGAELFAGSTRTSGILPRKSIVSNIHNTTRNNRYKLSDTVHSKYGASFEFYNYACMFMDYMYNKDMGILNKLNDLAKNNDVDGYDNYIRDLSSNYALNDKYQDHMQERIDNYENLTVPFVADDYLVRHAYKNPNEIYSEISEVAKLKDAKSEVKKSQYFSTFTLRGSYTGGASKGKLEDQKAMNKFIDDSLKKLDTYSWSGYKTLTAYFTNYKVDSSNRVTYDVVFHGYLPNEGDSKNSLPYGKINGTYKGTEKEKIKFSSEGSFDPDGKIVSYEWDFGDGNKSNEENPEHSYDKVGTYTVKLKVTDDKGESSVSTTTAEIKDLSENKLPVIYMHVPKSGALNQKVVFYGKGTYDPDGSIAGYQWDFGDGSDFSSEQNPSHVYTKKGEYTVTLRVMDSSGQMSEKTMKIKITDPVYPIGTEKEPNNSKETASGPIVPGIPVSGTIENTSDQDYFYFDVITPGEVKIDINKLGYGGATWVVYDENNNAVSYATDDGQNLSGKFKADKPGRYYIHLYMFNGSYMPYRINIEGSVGR

SEQ ID NO: 5196 - RNA, 3027 nt, Artificial Sequence
  derived and/or modified CDS sequence (wt) from Clostridium histolyticum__BAA77453.1__ColG(111-1118)
auagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 5197 - RNA, 3027 nt, Artificial Sequence
  derived and/or modified CDS sequence (wt) from Clostridium histolyticum__BAA77453.1__ColG(111-1118)
auagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 5198 - RNA, 3375 nt, Artificial Sequence
  derived and/or modified CDS sequence (wt) from Clostridium histolyticum__BAA77453.1__ColG(1-110)_CS-F_ColG(111-1118)
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacuaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaauucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcuuuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaauucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacuaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacuaguagaggcaaaaauucaguacaugcuuacaaaaaagcaggaacauauaauguuacauuaaaaguaacugacgauaagggugcaacagcuacagaaagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 5199 - RNA, 3375 nt, Artificial Sequence
  derived and/or modified CDS sequence (wt) from Clostridium histolyticum__BAA77453.1__ColG(1-110)_CS-F_ColG(111-1118)
augaaaaaaaauauuuuaaagauucuuauggauaguuauucuaaagaaucuaaaauucaaacuguacguaggguuacgaguguaucacuuuuagcgguauaucuuacuaugaauacuucaaguuuaguuuuagcaaaaccaauagaaaauacuaaugauacaaguauaaaaaauguggagaaauuaagaaaugcuccaaaugaagagaauaguaaaaagguagaagauaguaaaaaugauaagguagaacaugugaaaaauauagaagaggcaaagguugagcaaguugcacccgaaguaaaaucuaaaucaacuuuaagaagugcuucuagaaggcggcgcaagagaauagcgaauacuaauucugagaaauaugauuuugaguauuuaaaugguuugagcuauacugaacuuacaaauuuaauuaaaaauauaaaguggaaucaaauuaaugguuuauuuaauuauaguacagguucucaaaaguucuuuggagauaaaaaucguguacaagcuauaauuaaugcuuuacaagaaaguggaagaacuuacacugcaaaugauaugaaggguauagaaacuuucacugagguuuuaagagcugguuuuuauuuaggguacuauaaugaugguuuaucuuauuuaaaugauagaaacuuccaagauaaauguauaccugcaaugauugcaauucaaaaaaauccuaacuuuaagcuaggaacugcaguucaagaugaaguuauaacuucuuuaggaaaacuaauaggaaaugcuucugcuaaugcugaaguaguuaauaauuguguaccaguucuaaaacaauuuagagaaaacuuaaaucaauaugcuccugauuacguuaaaggaacagcuguaaaugaauuaauuaaagguauugaguucgauuuuucuggugcugcauaugaaaaagauguuaagacaaugccuugguauggaaaaauugauccauuuauaaaugaacuuaaggccuuaggucuauauggaaauauaacaagugcaacugagugggcaucugauguuggaauauacuauuuaaguaaauucggucuuuacucaacuaaccgaaaugacauaguacagucacuugaaaaggcuguagauauguauaaguaugguaaaauagccuuuguagcaauggagagaauaacuugggauuaugaugggauugguucuaaugguaaaaagguggaucacgauaaguucuuagaugaugcugaaaaacauuaucugccaaagacauauacuuuugauaauggaaccuuuauuauaagagcaggggauaagguauccgaagaaaaaauaaaaaggcuauauugggcaucaagagaagugaagucucaauuccauagaguaguuggcaaugauaaagcauuagaggugggaaaugccgaugauguuuuaacuaugaaaauauuuaauagcccagaagaauauaaauuuaauaccaauauaaaugguguaagcacugauaaugguggucuauauauagaaccaagagggacuuucuacacuuaugagagaacaccucaacaaaguauauuuagucuugaagaauuguuuagacaugaauauacucacuauuuacaagcgagauaucuuguagaugguuuaugggggcaagguccauuuuaugaaaaaaauagauuaacuugguuugaugaagguacagcugaguucuuugcaggaucuacccguacaucugguguuuuaccaagaaaaucaauauuaggauauuuggcuaaggauaaaguagaucauagauacucauuaaagaagacucuuaauucaggguaugaugacagugauuggauguucuauaauuauggauuugcaguugcacauuaccuauaugaaaaagauaugccuacauuuauuaagaugaauaaagcuauauugaauacagaugugaaaucuuaugaugaaauaauaaaaaaauuaagugaugaugcaaauaaaaauacagaauaucaaaaccauauucaagaguuagcagauaaauaucaaggagcaggcauaccucuaguaucagaugauuacuuaaaagaucauggauauaagaaagcaucugaaguauauucugaaauuucaaaagcugcuucucuuacaaacacaaguguaacagcagaaaaaucucaauauuuuaacacauucacuuuaagaggaacuuauacaggugaaacuucuaaaggugaauuuaaagauugggaugaaaugaguaaaaaauuagauggaacuuuggagucccuugcuaaaaauucuuggaguggauacaaaacuuuaacagcauacuuuacgaauuauagaguuacaagcgauaauaaaguucaauaugauguaguuuuccaugggguuuuaacagauaaugcggauauuaguaacaauaaggcuccaauagcaaagguaacuggaccaagcacuggugcuguaggaagaaauauugaauuuaguggaaaagauaguaaagaugaagaugguaaaauaguaucauaugauugggauuuuggcgauggugcaacaaguagaggcaaaaauucaguacaugcuuacaaaaaagcaggaacauauaauguuacauuaaaaguaacugacgauaagggugcaacagcuacagagagcuuuacuauagaaauaaagaacgaagauacaacaacaccuauaacuaaagaaauggaaccuaaugaugauauaaaagaggcuaaugguccaauaguugaagguguuacuguaaaaggugauuuaaaugguucugaugaugcugauaccuucuauuuugauguaaaagaagauggugauguuacaauugaacuuccuuauucagggucaucuaauuucacaugguuaguuuauaaagagggagacgaucaaaaccauauugcaagugguauagauaagaauaacucaaaaguuggaacauuuaaaucuacaaaaggaagacauuauguguuuauauauaaacacgauucugcuucaaauauauccuauucuuuaaacauaaaaggauuagguaacgagaaauugaaggaaaaagaaaauaaugauucuucugauaaagcuacaguuauaccaaauuucaauaccacuaugcaagguucacuuuuaggugaugauucaagagauuauuauucuuuugagguuaaggaagaaggcgaaguuaauauagaacuagauaaaaaggaugaauuugguguaacauggacacuacauccagagucaaauauuaaugacagaauaacuuacggacaaguugaugguaauaagguaucuaauaaaguuaaauuaagaccaggaaaauauuaucuacuuguuuauaaauacucaggaucaggaaacuaugaguuaaggguaaauaaauaa

SEQ ID NO: 5200 - RNA, 2946 nt, Artificial Sequence
  derived and/or modified CDS sequence (wt) from Clostridium histolyticum__BAA34542.1__ColH(41-1021)
guacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 5201 - RNA, 2946 nt, Artificial Sequence
  derived and/or modified CDS sequence (wt) from Clostridium histolyticum__BAA34542.1__ColH(41-1021)
guacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 5202 - RNA, 3084 nt, Artificial Sequence
  derived and/or modified CDS sequence (wt) from Clostridium histolyticum__BAA34542.1__ColH(1-40)_CS-F_ColH(41-1021)
augaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcuuucagacacuguacauucuaaauauggugcuaguuuugaauucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 5203 - RNA, 3084 nt, Artificial Sequence
  derived and/or modified CDS sequence (wt) from Clostridium histolyticum__BAA34542.1__ColH(1-40)_CS-F_ColH(41-1021)
augaaaaggaaauguuuaucuaaaaggcuuauguuagcuauaacaauggcuacaauauuuacagugaacaguacauuaccaauuuaugcagcuguagauaaaaauaaugcaacagcagcuagaaggcggcgcaagagaguacaaaaugaaaguaagagguauacaguaucauauuuaaagacuuuaaauuauuaugacuuaguagauuugcuuguuaagacugaaauugagaauuuaccagaccuuuuucaguauaguucagaugcaaaagaguucuauggaaauaaaacucguaugagcuuuaucauggaugaaauugguagaagggcaccucaguauacagagauagaucauaaagguauuccuacuuuaguagaaguuguaagagcuggauuuuacuuaggauuccauaacaaggaauugaaugaaauaaacaagaggucuuuuaaagaaaggguaauaccuucuauauuagcaauucaaaaaaauccuaauuuuaaacuagguacugaaguucaagauaaaauaguaucugcaacaggacuuuuagcugguaaugaaacagcgccuccagaaguuguaaauaauuuuacaccaauacuucaagacuguauaaagaauauagacagauacgcucuugaugauuuaaagucaaaagcauuauuuaauguuuuagcugcaccuaccuaugauauaacugaguauuuaagagcuacuaaagaaaaaccagaaaacacuccuugguaugguaaaauagauggguuuauaaaugaacuuaaaaaguuagcucuuuauggaaaaauaaaugauaauaacucuuggauaauagauaacgguauauaucauauagcaccuuuagggaaguuacauagcaauaauaaaauaggaauagaaacuuuaacagagguuaugaaaguuuauccuuauuuaaguaugcaacauuuacaaucagcagaucaaauuaagcgucauuaugauucaaaagaugcugaaggaaacaaaauaccuuuagauaaguuuaaaaaggaaggaaaagaaaaauacuguccaaaaacuuauacauuugaugauggaaaaguaauaauaaaagcuggugcuagaguagaagaagaaaaaguuaaaagacuauacugggcaucaaaggaaguuaacucucaauucuuuagaguauacggaauagacaaaccauuagaagaagguaauccagaugauauauuaacaaugguuaucuacaacagucccgaagaauauaaacucaauaguguucuauacggauaugauacuaauaauggugguauguauauagagccagaaggaacuuucuucaccuaugaaagagaagcucaagaaagcacauacacauuagaagaauuauuuagacaugaauauacacauuauuugcaaggaagauaugcaguuccaggacaauggggaagaacaaaacuuuaugacaaugauagauuaacuugguaugaagaagguggagcagaauuauuugcagguucuacuagaacuucuggaauauuaccaagaaagaguauaguaucaaauauucauaauacaacaagaaauaauagauauaagcugucagacacuguacauucuaaauauggugcuaguuuugaguucuauaauuaugcauguauguuuauggauuauauguauaauaaagauauggguauauuaaauaaacuaaaugaucuugcaaaaaauaaugauguugauggauaugauaauuauauuagagauuuaaguucuaauuaugcuuuaaaugauaaauaucaagaucauaugcaggagcgcauagauaauuaugaaaauuuaacagugccuuuuguagcugaugauuauuuaguaaggcaugcuuauaagaacccuaaugaaauuuauucugaaauaucugaaguagcaaaauuaaaggaugcuaagagugaaguuaagaaaucacaauauuuuaguaccuuuacuuugagagguaguuacacagguggagcaucuaaggggaaauuagaagaucaaaaagcaaugaauaaguuuauagaugauucacuuaagaaauuagauacguauucuuggaguggguauaaaacuuuaacugcuuauuucacuaauuauaaaguugacucuucaaauagaguuacuuaugauguaguauuccacggauauuuaccaaacgaaggugauuccaaaaauucauuaccuuauggcaagaucaauggaacuuacaagggaacagagaaagaaaaaaucaaauucucuagugaaggcucuuucgauccagaugguaaaauaguuucuuaugaaugggauuucggagaugguaauaagaguaaugaggaaaauccagagcauucauaugacaagguaggaacuuauacagugaaauuaaaaguuacugaugacaagggagaaucuucaguaucuacuacuacugcagaaauaaaggaucuuucagaaaauaaacuuccaguuauauauaugcauguaccuaaauccggagccuuaaaucaaaaaguuguuuucuauggaaaaggaacauaugacccagauggaucuaucgcaggauaucaaugggacuuuggugauggaagugauuuuagcagugaacaaaacccaagccauguauauacuaaaaaaggugaauauacuguaacauuaagaguaauggauaguaguggacaaaugagugaaaaaacuaugaagauuaagauuacagauccgguauauccaauaggcacugaaaaagaaccaaauaacaguaaagaaacugcaagugguccaauaguaccagguauaccuguuaguggaaccauagaaaauacaagugaucaagauuauuucuauuuugauguuauaacaccaggagaaguaaaaauagauauaaauaaauuaggguacggaggagcuacuuggguaguauaugaugaaaauaauaaugcaguaucuuaugccacugaugaugggcaaaauuuaaguggaaaguuuaaggcagauaaaccagguagauauuacauccaucuuuacauguuuaaugguaguuauaugccauauagaauuaauauagaagguucaguaggaagauaa

SEQ ID NO: 5204 - RNA, 3027 nt, Artificial Sequence
  derived and/or modified CDS sequence (opt1) from Clostridium histolyticum__BAA77453.1__ColG(111-1118)
aucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 5205 - RNA, 3375 nt, Artificial Sequence
  derived and/or modified CDS sequence (opt1) from Clostridium histolyticum__BAA77453.1__ColG(1-110)_CS-F_ColG(111-1118)
augaagaagaacauccugaagauccucauggacagcuacuccaaggagagcaagauccagaccgugcgccgggucaccuccgugagccugcuggccguguaccucacgaugaacaccuccagccugguccuggccaagcccaucgagaacaccaacgacaccuccaucaagaacguggagaagcuccgcaacgcgcccaacgaggagaacagcaagaagguggaggacuccaagaacgacaaggucgagcacgugaagaacaucgaggaggccaagguggagcaggucgcccccgaggugaagagcaaguccacgcugcggagcgccucccgccggcgccggaagcgcaucgccaacaccaacagcgagaaguacgacuucgaguaccugaacggccucuccuacaccgagcugaccaaccugaucaagaacaucaaguggaaccagaucaacgggcucuucaacuacagcacgggcucccagaaguucuucggggacaagaaccgcgugcaggcgaucaucaacgcccugcaggagagcggccggaccuacaccgccaacgacaugaaggggaucgagaccuucacggagguccugcgcgccggcuucuaccucggcuacuacaacgacgggcuguccuaccugaacgaccggaacuuccaggacaagugcauccccgcgaugaucgccauccagaagaaccccaacuucaagcucggcaccgccgugcaggacgaggugaucaccagccuggggaagcugaucggcaacgccagcgccaacgcggaggucgugaacaacugcgugccgguccucaagcaguuccgcgagaaccugaaccaguacgcccccgacuacgugaaggggaccgccgugaacgagcugaucaagggcaucgaguucgacuucuccggcgccgccuacgagaaggacgucaagacgaugcccugguacgggaagaucgaccccuucaucaacgagcucaaggcgcugggccuguacgggaacaucaccagcgccaccgagugggccuccgacgugggcaucuacuaccucagcaaguucggccuguacuccaccaaccggaacgacaucgugcagagccuggagaaggccgucgacauguacaaguacgggaagaucgccuucguggcgauggagcgcaucacgugggacuacgacggcaucggguccaacggcaagaaggucgaccacgacaaguuccucgacgacgccgagaagcacuaccugccgaagaccuacaccuucgacaacgggaccuucaucauccgggccggcgacaaggugagcgaggagaagaucaagcgccuguacugggccucccgggaggugaagagccaguuccaccgcgucgugggcaacgacaaggcccucgagguggggaacgcggacgacguccugacgaugaagaucuucaacucccccgaggaguacaaguucaacaccaacaucaacggcgugagcaccgacaacgggggccuguacaucgagccgcgggggaccuucuacacguacgagcgcaccccgcagcaguccaucuucagccucgaggagcuguuccggcacgaguacacccacuaccugcaggcccgcuaccucguggacggccuguggggccaggggccguucuacgagaagaaccggcugaccugguucgacgagggcacggccgaguucuucgccggguccacccgcaccagcggcguccucccccggaaguccauccugggguaccuggcgaaggacaagguggaccaccgcuacagccucaagaagacccugaacuccggcuacgacgacagcgacuggauguucuacaacuacggcuucgccguggcccacuaccuguacgagaaggacaugcccacguucaucaagaugaacaaggccauccugaacaccgacgucaagagcuacgacgagaucaucaagaagcucuccgacgacgccaacaagaacaccgaguaccagaaccacauccaggagcuggcggacaaguaccagggggccggcaucccccuggugagcgacgacuaccucaaggaccacggguacaagaaggccuccgagguguacagcgagaucuccaaggccgccagccugaccaacaccuccgucacggcggagaagagccaguacuucaacaccuucacccugcgcggcaccuacacgggcgagaccuccaagggggaguucaaggacugggacgagaugagcaagaagcucgacggcacccuggagucccuggccaagaacagcugguccggguacaagacccucacggccuacuucaccaacuaccgggugaccagcgacaacaaggugcaguacgacgucguguuccacggcgugcugaccgacaacgccgacaucuccaacaacaaggccccgaucgcgaaggucacggggcccagcaccggcgccgugggccgcaacaucgaguucuccgggaaggacagcaaggacgaggacggcaagaucgugagcuacgacugggacuucggggacggcgccaccucccgggggaagaacagcguccacgccuacaagaaggcgggcaccuacaacgugacgcugaaggugaccgacgacaagggcgccaccgccaccgaguccuucacgaucgagaucaagaacgaggacaccaccacccccaucacgaaggagauggagcccaacgacgacaucaaggaggccaacgggccgaucgucgagggcgugaccgugaagggggaccucaacggcagcgacgacgccgacaccuucuacuucgacgucaaggaggacggggacgugaccaucgagcugcccuacuccggcagcuccaacuucacguggcugguguacaaggagggcgacgaccagaaccacaucgcgagcgggaucgacaagaacaacuccaaggucggcaccuucaagagcaccaaggggcgccacuacguguucaucuacaagcacgacuccgccagcaacaucuccuacagccucaacaucaagggccuggggaacgagaagcugaaggagaaggagaacaacgacuccagcgacaaggccaccgugauccccaacuucaacacgaccaugcagggcucccuccugggcgacgacagccgggacuacuacuccuucgaggucaaggaggagggggaggugaacaucgagcuggacaagaaggacgaguucggcgugaccuggacccuccaccccgagagcaacaucaacgaccgcaucacguacgggcaggucgacggcaacaaggugagcaacaaggugaagcugcggccgggcaaguacuaccugcucgucuacaaguacuccgggagcggcaacuacgagcugcgcgugaacaaguga

SEQ ID NO: 5206 - RNA, 2946 nt, Artificial Sequence
  derived and/or modified CDS sequence (opt1) from Clostridium histolyticum__BAA34542.1__ColH(41-1021)
gugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 5207 - RNA, 3084 nt, Artificial Sequence
  derived and/or modified CDS sequence (opt1) from Clostridium histolyticum__BAA34542.1__ColH(1-40)_CS-F_ColH(41-1021)
augaagcgcaagugccugagcaagcggcucaugcuggccaucaccauggccaccaucuucacggugaacuccacccugcccaucuacgcggccgucgacaagaacaacgccaccgccgcccgccggcgccggaagcgcgugcagaacgagagcaagcgcuacaccguguccuaccucaagacgcugaacuacuacgaccuggucgaccuccuggugaagaccgagaucgagaaccugcccgaccucuuccaguacagcuccgacgcgaaggaguucuacggcaacaagacccggaugagcuucaucauggacgagaucgggcgccgggccccgcaguacaccgagaucgaccacaagggcauccccacgcugguggaggucgugcgcgccggguucuaccugggcuuccacaacaaggagcucaacgagaucaacaagcgguccuucaaggagcgcgugauccccagcauccuggccauccagaagaacccgaacuucaagcuggggaccgagguccaggacaagaucguguccgcgaccggccuccuggccggcaacgagaccgccccgcccgagguggucaacaacuucacgcccauccugcaggacugcaucaagaacaucgaccgguacgcccucgacgaccugaagagcaaggcccuguucaacgugcucgcggccccgaccuacgacaucaccgaguaccugcgcgccaccaaggagaagcccgagaacacgccgugguacgggaagaucgacggcuucaucaacgagcugaagaagcucgcccuguacgggaagaucaacgacaacaacuccuggaucaucgacaacggcaucuaccacaucgccccccuggggaagcuccacagcaacaacaagaucggcaucgagacccugaccgaggugaugaaggucuacccguaccuguccaugcagcaccuccagagcgcggaccagaucaagcggcacuacgacuccaaggacgccgagggcaacaagaucccccuggacaaguucaagaaggaggggaaggagaaguacugccccaagaccuacacguucgacgacggcaaggugaucaucaaggccggggcccgcguggaggaggagaaggucaagcggcuguacugggccagcaaggaggugaacucccaguucuuccgcguguacggcaucgacaagccccucgaggagggcaacccggacgacauccugaccauggucaucuacaacagccccgaggaguacaagcugaacuccgugcucuacggguacgacaccaacaacggcgggauguacaucgagcccgagggcaccuucuucacguacgagcgggaggcgcaggagagcaccuacacccuggaggagcuguuccgccacgaguacacccacuaccuccaggggcgguacgccgugcccggccaguggggccgcacgaagcuguacgacaacgaccggcugaccugguacgaggagggcggcgccgagcucuucgccgggagcacccgcaccuccgggauccugccgcggaagagcaucgucuccaacauccacaacacgacccgcaacaaccgcuacaagcugagcgacaccgugcacuccaaguacggggccagcuucgaguucuacaacuacgcgugcauguucauggacuacauguacaacaaggacaugggcauccucaacaagcugaacgaccuggccaagaacaacgacgucgacggcuacgacaacuacauccgggaccuguccagcaacuacgcccucaacgacaaguaccaggaccacaugcaggagcgcaucgacaacuacgagaaccugaccgugcccuucguggccgacgacuaccugguccggcacgcguacaagaaccccaacgagaucuacuccgagaucagcgagguggccaagcucaaggacgccaaguccgaggugaagaagagccaguacuucuccacguucacccugcgcgggagcuacaccggcggggccuccaagggcaagcuggaggaccagaaggccaugaacaaguucaucgacgacagccucaagaagcuggacaccuacuccuggagcggguacaagacccugacggcguacuucaccaacuacaaggucgacuccagcaaccgggugaccuacgacguggucuuccacggcuaccuccccaacgagggcgacagcaagaacucccugccguacgggaagaucaacggcaccuacaaggggacggagaaggagaagaucaaguucagcuccgagggcagcuucgaccccgacggcaagaucguguccuacgagugggacuucggggacggcaacaagagcaacgaggagaaccccgagcacuccuacgacaagguggggaccuacaccgucaagcugaaggugaccgacgacaagggcgagagcuccgugagcacgaccaccgccgagaucaaggaccucuccgagaacaagcugcccgucaucuacaugcacgugccgaagagcggggcccugaaccagaagguggucuucuacggcaagggcaccuacgaccccgacggguccaucgccggcuaccagugggacuucggggacggcagcgacuucuccagcgagcagaaccccucccacguguacacgaagaagggggaguacaccgugacccuccgcgucauggacagcagcggccagauguccgagaagaccaugaagaucaagaucacggacccgguguaccccaucggcaccgagaaggagcccaacaacagcaaggagaccgccuccgggcccaucgugccgggcauccccgucagcgggaccaucgagaacacguccgaccaggacuacuucuacuucgacgugaucacccccggcgaggugaagaucgacaucaacaagcugggguacggcggcgcgaccugggucguguacgacgagaacaacaacgccgugagcuacgccaccgacgacgggcagaaccuguccggcaaguucaaggccgacaagcccgggcgguacuacauccaccucuacauguucaacggcagcuacaugccguaccgcaucaacaucgagggguccgucggccgguga

SEQ ID NO: 5208 - RNA, 3027 nt, Artificial Sequence
  derived and/or modified CDS sequence (opt2) from Clostridium histolyticum__BAA77453.1__ColG(111-1118)
aucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 5209 - RNA, 3375 nt, Artificial Sequence
  derived and/or modified CDS sequence (opt2) from Clostridium histolyticum__BAA77453.1__ColG(1-110)_CS-F_ColG(111-1118)
augaagaagaacauccucaagauccucauggacuccuacuccaaggaguccaagauccagaccguccgccgcgucaccuccgucucccuccucgccgucuaccucaccaugaacaccuccucccucguccucgccaagcccaucgagaacaccaacgacaccuccaucaagaacgucgagaagcuccgcaacgcccccaacgaggagaacuccaagaaggucgaggacuccaagaacgacaaggucgagcacgucaagaacaucgaggaggccaaggucgagcaggucgcccccgaggucaaguccaaguccacccuccgcuccgccucccgccgccgccgcaagcgcaucgccaacaccaacuccgagaaguacgacuucgaguaccucaacggccucuccuacaccgagcucaccaaccucaucaagaacaucaaguggaaccagaucaacggccucuucaacuacuccaccggcucccagaaguucuucggcgacaagaaccgcguccaggccaucaucaacgcccuccaggaguccggccgcaccuacaccgccaacgacaugaagggcaucgagaccuucaccgagguccuccgcgccggcuucuaccucggcuacuacaacgacggccucuccuaccucaacgaccgcaacuuccaggacaagugcauccccgccaugaucgccauccagaagaaccccaacuucaagcucggcaccgccguccaggacgaggucaucaccucccucggcaagcucaucggcaacgccuccgccaacgccgaggucgucaacaacugcguccccguccucaagcaguuccgcgagaaccucaaccaguacgcccccgacuacgucaagggcaccgccgucaacgagcucaucaagggcaucgaguucgacuucuccggcgccgccuacgagaaggacgucaagaccaugcccugguacggcaagaucgaccccuucaucaacgagcucaaggcccucggccucuacggcaacaucaccuccgccaccgagugggccuccgacgucggcaucuacuaccucuccaaguucggccucuacuccaccaaccgcaacgacaucguccagucccucgagaaggccgucgacauguacaaguacggcaagaucgccuucgucgccauggagcgcaucaccugggacuacgacggcaucggcuccaacggcaagaaggucgaccacgacaaguuccucgacgacgccgagaagcacuaccuccccaagaccuacaccuucgacaacggcaccuucaucauccgcgccggcgacaaggucuccgaggagaagaucaagcgccucuacugggccucccgcgaggucaagucccaguuccaccgcgucgucggcaacgacaaggcccucgaggucggcaacgccgacgacguccucaccaugaagaucuucaacucccccgaggaguacaaguucaacaccaacaucaacggcgucuccaccgacaacggcggccucuacaucgagccccgcggcaccuucuacaccuacgagcgcaccccccagcaguccaucuucucccucgaggagcucuuccgccacgaguacacccacuaccuccaggcccgcuaccucgucgacggccucuggggccagggccccuucuacgagaagaaccgccucaccugguucgacgagggcaccgccgaguucuucgccggcuccacccgcaccuccggcguccucccccgcaaguccauccucggcuaccucgccaaggacaaggucgaccaccgcuacucccucaagaagacccucaacuccggcuacgacgacuccgacuggauguucuacaacuacggcuucgccgucgcccacuaccucuacgagaaggacaugcccaccuucaucaagaugaacaaggccauccucaacaccgacgucaaguccuacgacgagaucaucaagaagcucuccgacgacgccaacaagaacaccgaguaccagaaccacauccaggagcucgccgacaaguaccagggcgccggcaucccccucgucuccgacgacuaccucaaggaccacggcuacaagaaggccuccgaggucuacuccgagaucuccaaggccgccucccucaccaacaccuccgucaccgccgagaagucccaguacuucaacaccuucacccuccgcggcaccuacaccggcgagaccuccaagggcgaguucaaggacugggacgagauguccaagaagcucgacggcacccucgagucccucgccaagaacuccugguccggcuacaagacccucaccgccuacuucaccaacuaccgcgucaccuccgacaacaagguccaguacgacgucgucuuccacggcguccucaccgacaacgccgacaucuccaacaacaaggcccccaucgccaaggucaccggccccuccaccggcgccgucggccgcaacaucgaguucuccggcaaggacuccaaggacgaggacggcaagaucgucuccuacgacugggacuucggcgacggcgccaccucccgcggcaagaacuccguccacgccuacaagaaggccggcaccuacaacgucacccucaaggucaccgacgacaagggcgccaccgccaccgaguccuucaccaucgagaucaagaacgaggacaccaccacccccaucaccaaggagauggagcccaacgacgacaucaaggaggccaacggccccaucgucgagggcgucaccgucaagggcgaccucaacggcuccgacgacgccgacaccuucuacuucgacgucaaggaggacggcgacgucaccaucgagcuccccuacuccggcuccuccaacuucaccuggcucgucuacaaggagggcgacgaccagaaccacaucgccuccggcaucgacaagaacaacuccaaggucggcaccuucaaguccaccaagggccgccacuacgucuucaucuacaagcacgacuccgccuccaacaucuccuacucccucaacaucaagggccucggcaacgagaagcucaaggagaaggagaacaacgacuccuccgacaaggccaccgucauccccaacuucaacaccaccaugcagggcucccuccucggcgacgacucccgcgacuacuacuccuucgaggucaaggaggagggcgaggucaacaucgagcucgacaagaaggacgaguucggcgucaccuggacccuccaccccgaguccaacaucaacgaccgcaucaccuacggccaggucgacggcaacaaggucuccaacaaggucaagcuccgccccggcaaguacuaccuccucgucuacaaguacuccggcuccggcaacuacgagcuccgcgucaacaaguga

SEQ ID NO: 5210 - RNA, 2946 nt, Artificial Sequence
  derived and/or modified CDS sequence (opt2) from Clostridium histolyticum__BAA34542.1__ColH(41-1021)
guccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 5211 - RNA, 3084 nt, Artificial Sequence
  derived and/or modified CDS sequence (opt2) from Clostridium histolyticum__BAA34542.1__ColH(1-40)_CS-F_ColH(41-1021)
augaagcgcaagugccucuccaagcgccucaugcucgccaucaccauggccaccaucuucaccgucaacuccacccuccccaucuacgccgccgucgacaagaacaacgccaccgccgcccgccgccgccgcaagcgcguccagaacgaguccaagcgcuacaccgucuccuaccucaagacccucaacuacuacgaccucgucgaccuccucgucaagaccgagaucgagaaccuccccgaccucuuccaguacuccuccgacgccaaggaguucuacggcaacaagacccgcauguccuucaucauggacgagaucggccgccgcgccccccaguacaccgagaucgaccacaagggcauccccacccucgucgaggucguccgcgccggcuucuaccucggcuuccacaacaaggagcucaacgagaucaacaagcgcuccuucaaggagcgcgucauccccuccauccucgccauccagaagaaccccaacuucaagcucggcaccgagguccaggacaagaucgucuccgccaccggccuccucgccggcaacgagaccgccccccccgaggucgucaacaacuucacccccauccuccaggacugcaucaagaacaucgaccgcuacgcccucgacgaccucaaguccaaggcccucuucaacguccucgccgcccccaccuacgacaucaccgaguaccuccgcgccaccaaggagaagcccgagaacacccccugguacggcaagaucgacggcuucaucaacgagcucaagaagcucgcccucuacggcaagaucaacgacaacaacuccuggaucaucgacaacggcaucuaccacaucgccccccucggcaagcuccacuccaacaacaagaucggcaucgagacccucaccgaggucaugaaggucuaccccuaccucuccaugcagcaccuccaguccgccgaccagaucaagcgccacuacgacuccaaggacgccgagggcaacaagaucccccucgacaaguucaagaaggagggcaaggagaaguacugccccaagaccuacaccuucgacgacggcaaggucaucaucaaggccggcgcccgcgucgaggaggagaaggucaagcgccucuacugggccuccaaggaggucaacucccaguucuuccgcgucuacggcaucgacaagccccucgaggagggcaaccccgacgacauccucaccauggucaucuacaacucccccgaggaguacaagcucaacuccguccucuacggcuacgacaccaacaacggcggcauguacaucgagcccgagggcaccuucuucaccuacgagcgcgaggcccaggaguccaccuacacccucgaggagcucuuccgccacgaguacacccacuaccuccagggccgcuacgccguccccggccaguggggccgcaccaagcucuacgacaacgaccgccucaccugguacgaggagggcggcgccgagcucuucgccggcuccacccgcaccuccggcauccucccccgcaaguccaucgucuccaacauccacaacaccacccgcaacaaccgcuacaagcucuccgacaccguccacuccaaguacggcgccuccuucgaguucuacaacuacgccugcauguucauggacuacauguacaacaaggacaugggcauccucaacaagcucaacgaccucgccaagaacaacgacgucgacggcuacgacaacuacauccgcgaccucuccuccaacuacgcccucaacgacaaguaccaggaccacaugcaggagcgcaucgacaacuacgagaaccucaccguccccuucgucgccgacgacuaccucguccgccacgccuacaagaaccccaacgagaucuacuccgagaucuccgaggucgccaagcucaaggacgccaaguccgaggucaagaagucccaguacuucuccaccuucacccuccgcggcuccuacaccggcggcgccuccaagggcaagcucgaggaccagaaggccaugaacaaguucaucgacgacucccucaagaagcucgacaccuacuccugguccggcuacaagacccucaccgccuacuucaccaacuacaaggucgacuccuccaaccgcgucaccuacgacgucgucuuccacggcuaccuccccaacgagggcgacuccaagaacucccuccccuacggcaagaucaacggcaccuacaagggcaccgagaaggagaagaucaaguucuccuccgagggcuccuucgaccccgacggcaagaucgucuccuacgagugggacuucggcgacggcaacaaguccaacgaggagaaccccgagcacuccuacgacaaggucggcaccuacaccgucaagcucaaggucaccgacgacaagggcgaguccuccgucuccaccaccaccgccgagaucaaggaccucuccgagaacaagcuccccgucaucuacaugcacguccccaaguccggcgcccucaaccagaaggucgucuucuacggcaagggcaccuacgaccccgacggcuccaucgccggcuaccagugggacuucggcgacggcuccgacuucuccuccgagcagaaccccucccacgucuacaccaagaagggcgaguacaccgucacccuccgcgucauggacuccuccggccagauguccgagaagaccaugaagaucaagaucaccgaccccgucuaccccaucggcaccgagaaggagcccaacaacuccaaggagaccgccuccggccccaucguccccggcauccccgucuccggcaccaucgagaacaccuccgaccaggacuacuucuacuucgacgucaucacccccggcgaggucaagaucgacaucaacaagcucggcuacggcggcgccaccugggucgucuacgacgagaacaacaacgccgucuccuacgccaccgacgacggccagaaccucuccggcaaguucaaggccgacaagcccggccgcuacuacauccaccucuacauguucaacggcuccuacaugcccuaccgcaucaacaucgagggcuccgucggccgcuga

SEQ ID NO: 5212 - RNA, 3027 nt, Artificial Sequence
  derived and/or modified CDS sequence (opt3) from Clostridium histolyticum__BAA77453.1__ColG(111-1118)
auugcuaacacaaauagugagaaauaugacuuugaauaccugaacggcuugagcuauacugaguuaacgaaucugauaaagaacaucaaauggaaucagauuaacgggcuauucaauuacuccaccggaucucaaaaguuuuucggugauaaaaacagaguccaggcaaucauuaaugcccuccaggaaucgggcaggacauauacugcgaacgacaugaaggggaucgagaccuuuacagaaguucugcgggcuggauucuaccuuggcuauuacaaugauggucugucauacuugaacgaccgcaauuuucaggauaagugcauacccgccaugaucgcaauucagaaaaacccuaauuucaagcucgggaccgccgugcaagacgagguaaucacuagccugggaaaacugauuggcaacgcuagugcaaacgccgagguggucaauaacugugugccaguucucaagcaguuucgagaaaauuuaaaccaguaugcuccggauuacgugaaaggcacagccgucaaugagcugaucaaggggauagaauuugacuuuuccggagcggcauaugagaaggaugugaaaaccaugcccugguacgguaagauugacccuuucaucaacgagcuuaaagccuugggccuguaugggaauauuacgucugcuacugaaugggccagcgauguaggaaucuacuaucuauccaaguucggccucuacucaaccaaccguaaugacaucguucaaagucuggagaaagcaguggauauguacaaguaugguaaaauugcuuuugucgccauggaaagaauaacaugggacuacgacgggaucggaagcaacggcaagaagguggaucacgacaaauuccuugaugacgcggagaagcauuaucugccaaaaacuuacaccuuugauaauggcacauucauuaucagggccggggacaaggugucugaagagaaaauaaagcgguuguauugggcaucccgcgaggucaagucacaguuucacagaguugugggaaacgauaaagcucucgaaguagguaaugccgacgaugugcugaccaugaagauuuucaacagccccgaggaauacaaauuuaauacgaacaucaacggcgucaguacugacaaugggggauuauauaucgagccuaggggcacauucuacaccuacgaacggacuccacagcagucuauuuucucccuggaggagcuguuccgccaugaauauacacacuaccuucaagcucgauaucugguggaugguuugugggggcagggccccuuuuacgagaagaacagacuaaccugguucgacgaaggaacggccgaguuuuucgcaggcagcaccaggacaucggggguucugccucggaaaucuauccucggauaucuggccaaggacaagguggaucaucguuacucccuuaaaaagacucucaauucagguuaugacgauagugacuggauguucuacaacuacggcuuugcugucgcgcacuauuuguacgaaaaagauaugccaaccuucauuaagaugaauaaagcaauacucaacacagacguaaagagcuaugaugagaucauuaagaaacuguccgacgaugccaauaagaacacugaguaccagaaucacauccaagaauuagcugacaaauaucagggggccggaaucccgcuggugucugaugacuaccuaaaggaucauggcuauaaaaaggcaagcgagguuuacucagaaauuaguaaagccgcuucccucaccaacacaagcgugaccgccgagaagucucaguacuuuaauacuuucacgcugcgcgguacauauaccggggagacuucaaagggcgaauuuaaagacugggacgagaugaguaagaaacuugauggaaccuuggaaagccuggcaaagaacuccuggucuggcuacaaaacacucaccgcguauuucacuaauuacagagucacaucggacaacaaggugcaguaugaugucguguuucacgggguucugacggacaaugcugauauaagcaacaacaaggcccccaucgcaaaagugaccggaccuuccacuggugccguaggcaggaauauugaguucucagggaaggacaguaaagaugaagacggaaagaucgucucuuacgauugggacuuuggcgauggugcuacaagccgggggaaaaacuccgugcaugccuauaagaaggcaggcaccuacaauguuacacuuaaagugacugacgauaagggagcuaccgccacggagucauucaccauugagaucaaaaacgaagacacaacuaccccaauaacaaaggagauggaacccaaugacgauaucaaagaggcgaacggcccuauugucgaaggggugacuguaaagggagaccugaauggcagcgaugacgccgauaccuuuuacuucgacgugaaggaggauggugacguuacgaucgaguugccauauucuggguccaguaacuuuacauggcucgucuacaaagaaggagaugaccaaaaucacauugcuagcggcaucgauaagaacaauucuaaaguggguaccuucaaguccacuaaaggccgacacuauguguucauauacaagcaugacucagcaaguaacauuagcuauucgcugaauaucaaaggguuaggaaacgagaagcugaaggaaaaagagaauaacgacuccucugauaaggccacagucauucccaacuuuaauaccacuaugcagggcagccuacucggggacgauucacgcgacuacuauaguuucgaaguuaaagaggagggagaagugaacaucgagcuggauaagaaagacgaauuuggcgugaccuggacacuucacccggaguccaauauaaacgauagaaucacguacggucagguagacgggaauaaggucucuaacaaggugaaauugaggccuggaaaguacuaucugcucguuuacaaauauagcggcuccgguaauuacgagcugcgggugaacaaguga

SEQ ID NO: 5213 - RNA, 3375 nt, Artificial Sequence
  derived and/or modified CDS sequence (opt3) from Clostridium histolyticum__BAA77453.1__ColG(1-110)_CS-F_ColG(111-1118)
augaaaaagaacauucugaaaauauugauggacaguuauagcaaggaguccaaaauccagacagucagaaggguuacuucugugucguuacuggcuguauaccuaacgaugaauaccucaagccucgugcuggcaaagcccauugaaaacacaaaugauacuagcaucaagaacgucgagaaacuucggaaugccccuaacgaagaaaauuccaagaaaguggaagacucuaagaacgauaaaguugagcacgugaagaauauugaggaagcgaaggucgagcaaguggcuccagaaguaaaaagcaaguccacccugcgcucagccagucgacguagaaggaaacggaucgcaaacacaaauagcgagaaguaugacuuugaguacuugaacggccucucuuauaccgaacugacuaaucugaucaaaaacauaaaguggaaucagauuaacggacucuucaacuacuccacaggaucacagaaauuuuucggugauaagaaucgcguucaggccaucauuaacgcuuuacaagagagcggcagaaccuauacggcaaaugacaugaaggggaucgaaacuuuuaccgaggugcugagggccggauucuaccuuggcuacuauaacgaugguuugaguuaccugaaugaccggaacuuucaggauaaaugcauaccggcuaugauugccauccagaagaaucccaacuucaaacuagggacagcgguccaggacgaagugauuacuucucucggaaagcugaucggcaaugcauccgccaacgcugagguggucaauaacuguguuccugugcuuaaacaauuucgcgagaaucugaaccaguaugccccagauuacguaaagggcaccgcagugaaugaauugaucaaggggauugaguucgacuuuagcggagcugccuaugaaaaagaugucaagacaaugcccugguacgguaaaauagacccuuucaucaacgagcucaaggcgcugggcuuauaugggaacauuaccucggccacggaaugggcaucugacgugggaaucuacuaccuguccaaauucggccucuauucaacuaaucgaaacgauauaguucagagucuugagaaggcuguggacauguacaaguaugguaaaauugccuuugucgcuauggagagaaucacaugggauuacgacgggaucggaagcaauggcaagaaaguggaucaugacaaguuccuggaugacgccgaaaaacacuauuugccaaagaccuacacuuuugauaacggcacauucauuaucagggcaggggacaagguauccgaggagaaaauuaagcggcuauauugggccucucgugagguuaaaagccaguuucaucgcguggucggaaaugauaaggcucuggaaguggguaacgcggacgacguccucaccaugaaaauauucaauucacccgaggaguacaaguuuaacacgaauaucaacggcgugaguaccgauaaugggggacuguacauugaaccuagaggcacauucuauacuuacgagaggaccccacaacaguccaucuuuagccuugaggaacuguuccggcacgaguauacacauuacuugcaggcacgauaucucguugacggucugugggggcaaggcccguuuuacgagaaaaaccgcuuaacuugguucgaugaaggaaccgccgaauuuuucgcuggcucuacaagaaccucaggggugcugcccaggaagaguauccuaggauaucucgccaaggacaaaguagaucaccgguacagccugaagaaaacucuuaauuccgguuacgacgauucugacuggauguucuauaacuacggcuuugcagucgcccacuauuuguacgagaaggauaugccuacguucauuaaaaugaauaaggcuauacugaacacagacgugaagucguaugaugaaaucauuaaaaagcucagcgacgaugccaacaaaaauaccgaguaccagaaccauauccaggagcuggcagacaaguaucagggggcggggauuccacuuguuuccgacgauuaccugaaagaccacggcuacaagaaggcuucagaaguguauagugagaucucuaaagccgcaaguuugacuaauaccuccgucacagccgaaaagucacaauacuuuaacaccuucacucuccgcgguacauauacgggggagaccagcaaaggcgaauuuaaggauugggacgagaugucuaaaaagcuggauggaacuuuagagucccuggcuaagaauaguuggagcggcuacaaaacacuaaccgccuauuucacaaacuacagagugacuucugacaauaagguacaguaugaugugguuuuucaugggguccucaccgacaacgcagauauauccaauaacaaagcucccaucgccaaggugacgggaccuucaaccggugcggugggcaggaauauugaguucagugggaaagacagcaaggaugaagacggaaaaaucgucucguacgauugggacuuuggcgacggugccacaucccgugggaagaacucuguucacgcuuacaagaaagcaggcacuuauaaugugacccugaaggugacagaugacaaaggagccacugcuaccgagagcuucacgauugaaaucaagaacgaagauacaaccacuccaauaacaaaagagauggagcccaaugacgauauuaaggaagccaacggcccgaucguagagggggucaccgugaagggagaccuuaacggcucagaugacgcagauacuuuuuacuucgacguuaaagaagauggugacgugaccauugaguugccuuauaguggguccucuaauuuuacauggcuggucuacaaggagggagacgaucagaaccacaucgcgagcggcauagacaaaaauaacuccaagguggguacguucaaaucaaccaagggccggcauuauguuuucaucuacaagcacgauagcgccaguaauauuucuuauucccucaacaucaaagggcugggaaaugaaaaguuaaaagagaaggaaaacaaugacagcucggauaaagcuacugugauucccaacuuuaauacaaccaugcagggcucacugcuuggggacgauucucgagacuacuacaguuucgagguaaaggaagagggagaggucaacaucgaauuggauaagaaagacgaguuuggcgugacauggacucuccauccagaauccaauauaaacgauagaauuaccuauggucaaguggacgggaauaaggucagcaacaaaguuaagcugaggccuggaaaauacuaucuacugguguacaaguauucuggcagcgguaauuacgagcuccgcguaaacaaguga

SEQ ID NO: 5214 - RNA, 2946 nt, Artificial Sequence
  derived and/or modified CDS sequence (opt3) from Clostridium histolyticum__BAA34542.1__ColH(41-1021)
guccagaacgagaguaaaagauauacaguuagcuaccugaagacuuugaauuauuacgacuuaguggaucugcuaguaaaaacggaaauugagaaccuccccgaccuguuucaauauuccucugaugcuaaggaguucuacggcaauaaaaccaggaugucguuuauaauggacgaaaucggccggcgcgcaccucaguauacagaaauugaucacaagggaaucccaacucuuguggaggucgugcgagccgguuucuaccugggcuuucauaacaaggaguugaaugaaauuaacaaacguucauucaaggagagaguuaucccgagcauacucgcgauccagaaaaaucccaacuuuaagcuggggaccgaagugcaggacaaaauugucagugcuacaggacugcucgccggcaaugagaccgcaccuccagaggugguaaacaauuucacucccaucuuacaagauugcauuaagaacaucgacagguacgcccuggaugaccuuaaguccaaggcuuuguuuaauguucuggcagccccuacauaugauauaaccgaauaccuacgggcuacgaaggagaaaccagaaaacacucccugguaugguaagauugacggguucaucaaugagcucaaaaagcuggcccuuuacggaaaaauuaacgauaacaauucuuggaucaucgacaacggcauuuaucacauagcgccucugggcaaguugcauagcaauaacaagaucgggauugaaacccucacagaggugaugaaagucuacccauaucuguccaugcagcacuuacagucagcagaccagaucaagcgccauuacgauaguaaagacgccgagggaaauaagauaccgcuggauaaauuuaagaaggaagguaaagagaaguacugucccaaaacuuauaccuucgacgauggcaaggugauuaucaaagcuggggccagaguggaagaggaaaaggucaagaggcucuacugggcaagcaaagagguuaacucucaauucuuucggguguauggaaucgacaagccucuugaggaaggcaauccagaugacauucugacaaugguaaucuacaacucccccgaggaauauaaacuaaauucaguguuguacgguuaugauaccaacaaugggggaauguacauugagccugaaggcacguucuuuacuuacgagcgcgaggcucaggaaagcacauauacccuggaggaacucuuccgacacgaguacacucacuaucugcagggcagauacgccgucccagggcaguggggaaggacaaaacuuuaugacaacgaucggcugaccugguacgaggaagguggcgcggaguuguuugccgggaguacgcguaccucuggaauacucccccgcaaauccaucgugagcaauauucauaacacaacuagaaauaacagguauaagcugucggacaccguucacucuaaguacggcgcauccuucgaauuuuacaacuaugcuugcauguucauggacuacauguauaauaaagauauggguaucuuaaacaagcugaaugaccuagccaaaaacaaugauguggacggguacgauaacuauauccgggaccucucaaguaauuacgcucugaacgauaaguaucaagaccauaugcaggagcgaauugauaauuacgaaaaccuuacagucccguuuguggccgacgauuacuugguacgccacgcauauaaaaauccuaacgagauauacagcgagaucuccgaaguugccaagcugaaagacgcuaagucugaggugaagaaaagccaguauuucucaacuuuuacccucagaggcaguuacacaggaggcgcguccaaggggaaacuggaagaucaaaaggcaaugaauaaauucauugacgacagccuuaagaagcuggauaccuauucuuggucaggauacaaaacuuugacggccuauuuuacaaacuacaaggucgacaguagcaauagggugaccuacgaugucguguuccacgguuaucuccccaacgagggcgacuccaaaaacucucugccauacgggaagaucaauggaacuuauaaaggcaccgaaaaggagaagauuaaauucucgagcgaggguuccuuugauccugacgggaagaucguuucauacgaaugggauuucggcgacggaaacaaaaguaaugaggaaaaccccgagcauucuuaugauaaggugggcacauacaccguaaaauuaaaggucacugacgauaagggggaaagcuccgugucaacaacgaccgcugagauaaaagaccugagcgagaauaagcuaccaguuaucuauaugcacgugcccaaaucuggagcccucaaccagaaggucguguuuuacgguaaaggcacuuacgauccugacggguccauugcaggauaucagugggacuucggcgaugguagugacuuuagcucugaacagaauccaucccauguauacacaaagaaaggggaguauaccgugacacugcggguuauggauucaaguggccaaaugagcgaaaagacuaugaagaucaaaauuaccgacccggucuaccccaucggaacggagaaggagccuaacaauucgaaagaaaccgccuccggcccaauagugcccgggauuccugugucuggaacaaucgagaacacuagcgaucaggacuauuucuacuuugaugucauuaccccaggcgaaguuaagaucgacauaaauaaacuugguuaugggggagcuacaugggugguguacgaugagaacaauaacgccguaucauacgcaacugacgauggccagaauuugagugguaaguucaaggcggacaaacccggccgcuauuacauccaccuguauauguuuaacggguccuacaugccguauagaauuaacaucgaaggaucugucgggagguga

SEQ ID NO: 5215 - RNA, 3084 nt, Artificial Sequence
  derived and/or modified CDS sequence (opt3) from Clostridium histolyticum__BAA34542.1__ColH(1-40)_CS-F_ColH(41-1021)
augaaaagaaagugccugaguaaaagguugauguuagcuauuacaauggcaacuauauuuacggucaacagcacccugcccaucuaugccgcgguugacaagaauaacgcuacagccgcacggcgccgacguaaaagagugcagaaugaguccaagagguacacuguaucuuaucuaaagacccucaacuacuaugaucugguggaccuucuggucaaaacagaaauugagaauuugccugaucucuuccaauacucgucagacgccaaggaauuuuauggcaacaaaacccggaugagcuucaucauggaugagauugggcgcagagcuccacaguacacugaaaucgaccacaagggaauaccgacacugguggagguugugagggcagguuuuuaccugggcuuccauaauaaagagcucaacgaaaucaauaagcggaguuuuaaggagcgcgucauucccuccaucuuagccauucagaaaaacccuaauuucaagcuggggaccgaagugcaggauaaaaucguaucugcuacgggacuuuuggccggcaacgagacugcgccacccgagguugugaauaacuuuaccccuauacugcaagacuguauuaagaauaucgaucgauaugcacuagacgaucucaaaagcaaggcccuguucaacguccuugcugccccaacauacgacauuacugaauaucugagagcaaccaaagagaagcccgaaaacacaccuugguacgguaagaucgauggguuuaucaaugaguugaaaaagcucgcucuguauggaaaaauuaacgacaauaacuccuggauaaucgacaauggcauuuaccacaucgccccauuaggcaagcugcauucaaacaauaaaauagggauugaaacccucacggaggugaugaagguguauccguaccuuaguaugcagcaucugcagagcgcggaucagaucaagaggcacuacgacucuaaagaugccgagggaaacaagauccccuuggacaaauucaagaaagaagguaaggagaaguauugcccuaaaacuuacacauucgaugacggcaaggucauuaucaaagcaggggcucggguugaagaggaaaaggugaaacgucuauauugggccuccaaggagguaaauucacaauuuuuccgcguguacggaauugauaagccacuggaggaaggcaaccccgacgauauacucaccauggucaucuauaauagcccugaggaauacaaacugaacagugugcuuuaugguuacgacacuaauaacgggggaauguacauugagccagaaggcacauuuuucaccuaugagagagaggcucaggaaucuacguacacccuggaggaauuguuuaggcacgaguauacacacuaccuccagggccgguaugccguucccgggcaguggggacgaacuaagcuguacgauaaugaccgcuuaaccugguaugaggaagguggcgcagagcuguucgccggguccacaagaacuagcggaauccuaccgaggaaaucgaucgugucuaacauucauaacaccacacggaauaaccgcuacaagcucuccgacaccguccacucaaaauacggcgcuaguuuugaguucuauaauuacgcguguauguuuauggauuauauguacaacaaggacauggguauacugaauaaacuuaacgauuuggcaaagaauaacgacguggauggguaugacaauuacaucagagaucugagcuccaacuaugcccucaaugacaaguaccaagaucauaugcaggaaaggauugacaacuacgaaaaucugacuguaccuuucguugcugaugacuaucuugugcgucacgccuacaaaaaccccaaugagaucuauucugagauuagcgaagucgcaaagcugaaagaugccaagucagaggugaaaaagagucaguacuuuuccacguucacauugcggggcagcuauaccggaggcgcuucuaaggggaaacucgaagaccaaaaggccaugaacaaauuuaucgacgauucacugaagaaauuagacacuuacaguuggagcggauauaagacccugacagcauacuucaccaacuacaaggucgauuccucuaaucgagugacuuaugacguuguguuccacgguuaccuaccaaacgagggcgauucgaaaaauagccucccuuaugggaagauaaacggaacauacaaaggcacggaaaaggagaaaaucaaguuuuccucagaggguaguuucgaccccgaugggaagauuguaucuuaugaaugggacuuuggcgauggaaauaaaagcaacgaggaaaauccagagcauuccuacgacaaggucggcaccuauacugugaaacugaagguuacagaugacaaaggggaaucaagcgugucuaccacaacugcggagaucaaggaucuuuccgagaacaaauugcccgucauuuacaugcacgugccuaagaguggagcucugaaucagaagguaguguucuacgguaaaggcaccuaugacccagacgggagcaucgccggauaccagugggauuuuggcgacgguucugauuucuccucagaacagaacccgagucauguuuauacgaagaaaggggaguacaccgucacacucagagugauggacagcucgggccaaauguccgaaaagacuaugaaaauaaagauuaccgaucccguguauccuaucggaacagagaaggagccaaauaacucuaaagaaacugcaagcggccccauugucccugggaucccaguuucaggaaccauagagaauacgagugaccaggauuacuuuuauuucgacgugaucacacccggcgaagugaagauugauaucaacaaacuggguuacgggggagccaccuggguagucuacgacgagaauaacaacgcuguguccuaugccacugaugacggccagaauuuaucugguaaguuuaaagcagacaagccgggcagguacuauauucaccuguacauguucaacgggagcuauaugccuuaccgcaucaauauagaaggauccguuggccgguga

SEQ ID NO: 5216 - RNA, 3027 nt, Artificial Sequence
  derived and/or modified CDS sequence (opt4) from Clostridium histolyticum__BAA77453.1__ColG(111-1118)
aucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 5217 - RNA, 3375 nt, Artificial Sequence
  derived and/or modified CDS sequence (opt4) from Clostridium histolyticum__BAA77453.1__ColG(1-110)_CS-F_ColG(111-1118)
augaagaagaacauccugaagauccugauggacagcuacagcaaggagagcaagauccagaccgugagaagagugaccagcgugagccugcuggccguguaccugaccaugaacaccagcagccuggugcuggccaagcccaucgagaacaccaacgacaccagcaucaagaacguggagaagcugagaaacgcccccaacgaggagaacagcaagaagguggaggacagcaagaacgacaagguggagcacgugaagaacaucgaggaggccaagguggagcagguggcccccgaggugaagagcaagagcacccugagaagcgccagcagaagaagaagaaagagaaucgccaacaccaacagcgagaaguacgacuucgaguaccugaacggccugagcuacaccgagcugaccaaccugaucaagaacaucaaguggaaccagaucaacggccuguucaacuacagcaccggcagccagaaguucuucggcgacaagaacagagugcaggccaucaucaacgcccugcaggagagcggcagaaccuacaccgccaacgacaugaagggcaucgagaccuucaccgaggugcugagagccggcuucuaccugggcuacuacaacgacggccugagcuaccugaacgacagaaacuuccaggacaagugcauccccgccaugaucgccauccagaagaaccccaacuucaagcugggcaccgccgugcaggacgaggugaucaccagccugggcaagcugaucggcaacgccagcgccaacgccgagguggugaacaacugcgugcccgugcugaagcaguucagagagaaccugaaccaguacgcccccgacuacgugaagggcaccgccgugaacgagcugaucaagggcaucgaguucgacuucagcggcgccgccuacgagaaggacgugaagaccaugcccugguacggcaagaucgaccccuucaucaacgagcugaaggcccugggccuguacggcaacaucaccagcgccaccgagugggccagcgacgugggcaucuacuaccugagcaaguucggccuguacagcaccaacagaaacgacaucgugcagagccuggagaaggccguggacauguacaaguacggcaagaucgccuucguggccauggagagaaucaccugggacuacgacggcaucggcagcaacggcaagaagguggaccacgacaaguuccuggacgacgccgagaagcacuaccugcccaagaccuacaccuucgacaacggcaccuucaucaucagagccggcgacaaggugagcgaggagaagaucaagagacuguacugggccagcagagaggugaagagccaguuccacagaguggugggcaacgacaaggcccuggaggugggcaacgccgacgacgugcugaccaugaagaucuucaacagccccgaggaguacaaguucaacaccaacaucaacggcgugagcaccgacaacggcggccuguacaucgagcccagaggcaccuucuacaccuacgagagaaccccccagcagagcaucuucagccuggaggagcuguucagacacgaguacacccacuaccugcaggccagauaccugguggacggccuguggggccagggccccuucuacgagaagaacagacugaccugguucgacgagggcaccgccgaguucuucgccggcagcaccagaaccagcggcgugcugcccagaaagagcauccugggcuaccuggccaaggacaagguggaccacagauacagccugaagaagacccugaacagcggcuacgacgacagcgacuggauguucuacaacuacggcuucgccguggcccacuaccuguacgagaaggacaugcccaccuucaucaagaugaacaaggccauccugaacaccgacgugaagagcuacgacgagaucaucaagaagcugagcgacgacgccaacaagaacaccgaguaccagaaccacauccaggagcuggccgacaaguaccagggcgccggcaucccccuggugagcgacgacuaccugaaggaccacggcuacaagaaggccagcgagguguacagcgagaucagcaaggccgccagccugaccaacaccagcgugaccgccgagaagagccaguacuucaacaccuucacccugagaggcaccuacaccggcgagaccagcaagggcgaguucaaggacugggacgagaugagcaagaagcuggacggcacccuggagagccuggccaagaacagcuggagcggcuacaagacccugaccgccuacuucaccaacuacagagugaccagcgacaacaaggugcaguacgacgugguguuccacggcgugcugaccgacaacgccgacaucagcaacaacaaggcccccaucgccaaggugaccggccccagcaccggcgccgugggcagaaacaucgaguucagcggcaaggacagcaaggacgaggacggcaagaucgugagcuacgacugggacuucggcgacggcgccaccagcagaggcaagaacagcgugcacgccuacaagaaggccggcaccuacaacgugacccugaaggugaccgacgacaagggcgccaccgccaccgagagcuucaccaucgagaucaagaacgaggacaccaccacccccaucaccaaggagauggagcccaacgacgacaucaaggaggccaacggccccaucguggagggcgugaccgugaagggcgaccugaacggcagcgacgacgccgacaccuucuacuucgacgugaaggaggacggcgacgugaccaucgagcugcccuacagcggcagcagcaacuucaccuggcugguguacaaggagggcgacgaccagaaccacaucgccagcggcaucgacaagaacaacagcaaggugggcaccuucaagagcaccaagggcagacacuacguguucaucuacaagcacgacagcgccagcaacaucagcuacagccugaacaucaagggccugggcaacgagaagcugaaggagaaggagaacaacgacagcagcgacaaggccaccgugauccccaacuucaacaccaccaugcagggcagccugcugggcgacgacagcagagacuacuacagcuucgaggugaaggaggagggcgaggugaacaucgagcuggacaagaaggacgaguucggcgugaccuggacccugcaccccgagagcaacaucaacgacagaaucaccuacggccagguggacggcaacaaggugagcaacaaggugaagcugagacccggcaaguacuaccugcugguguacaaguacagcggcagcggcaacuacgagcugagagugaacaaguga

SEQ ID NO: 5218 - RNA, 2946 nt, Artificial Sequence
  derived and/or modified CDS sequence (opt4) from Clostridium histolyticum__BAA34542.1__ColH(41-1021)
gugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 5219 - RNA, 3084 nt, Artificial Sequence
  derived and/or modified CDS sequence (opt4) from Clostridium histolyticum__BAA34542.1__ColH(1-40)_CS-F_ColH(41-1021)
augaagagaaagugccugagcaagagacugaugcuggccaucaccauggccaccaucuucaccgugaacagcacccugcccaucuacgccgccguggacaagaacaacgccaccgccgccagaagaagaagaaagagagugcagaacgagagcaagagauacaccgugagcuaccugaagacccugaacuacuacgaccugguggaccugcuggugaagaccgagaucgagaaccugcccgaccuguuccaguacagcagcgacgccaaggaguucuacggcaacaagaccagaaugagcuucaucauggacgagaucggcagaagagccccccaguacaccgagaucgaccacaagggcauccccacccugguggagguggugagagccggcuucuaccugggcuuccacaacaaggagcugaacgagaucaacaagagaagcuucaaggagagagugauccccagcauccuggccauccagaagaaccccaacuucaagcugggcaccgaggugcaggacaagaucgugagcgccaccggccugcuggccggcaacgagaccgccccccccgagguggugaacaacuucacccccauccugcaggacugcaucaagaacaucgacagauacgcccuggacgaccugaagagcaaggcccuguucaacgugcuggccgcccccaccuacgacaucaccgaguaccugagagccaccaaggagaagcccgagaacacccccugguacggcaagaucgacggcuucaucaacgagcugaagaagcuggcccuguacggcaagaucaacgacaacaacagcuggaucaucgacaacggcaucuaccacaucgccccccugggcaagcugcacagcaacaacaagaucggcaucgagacccugaccgaggugaugaagguguaccccuaccugagcaugcagcaccugcagagcgccgaccagaucaagagacacuacgacagcaaggacgccgagggcaacaagaucccccuggacaaguucaagaaggagggcaaggagaaguacugccccaagaccuacaccuucgacgacggcaaggugaucaucaaggccggcgccagaguggaggaggagaaggugaagagacuguacugggccagcaaggaggugaacagccaguucuucagaguguacggcaucgacaagccccuggaggagggcaaccccgacgacauccugaccauggugaucuacaacagccccgaggaguacaagcugaacagcgugcuguacggcuacgacaccaacaacggcggcauguacaucgagcccgagggcaccuucuucaccuacgagagagaggcccaggagagcaccuacacccuggaggagcuguucagacacgaguacacccacuaccugcagggcagauacgccgugcccggccaguggggcagaaccaagcuguacgacaacgacagacugaccugguacgaggagggcggcgccgagcuguucgccggcagcaccagaaccagcggcauccugcccagaaagagcaucgugagcaacauccacaacaccaccagaaacaacagauacaagcugagcgacaccgugcacagcaaguacggcgccagcuucgaguucuacaacuacgccugcauguucauggacuacauguacaacaaggacaugggcauccugaacaagcugaacgaccuggccaagaacaacgacguggacggcuacgacaacuacaucagagaccugagcagcaacuacgcccugaacgacaaguaccaggaccacaugcaggagagaaucgacaacuacgagaaccugaccgugcccuucguggccgacgacuaccuggugagacacgccuacaagaaccccaacgagaucuacagcgagaucagcgagguggccaagcugaaggacgccaagagcgaggugaagaagagccaguacuucagcaccuucacccugagaggcagcuacaccggcggcgccagcaagggcaagcuggaggaccagaaggccaugaacaaguucaucgacgacagccugaagaagcuggacaccuacagcuggagcggcuacaagacccugaccgccuacuucaccaacuacaagguggacagcagcaacagagugaccuacgacgugguguuccacggcuaccugcccaacgagggcgacagcaagaacagccugcccuacggcaagaucaacggcaccuacaagggcaccgagaaggagaagaucaaguucagcagcgagggcagcuucgaccccgacggcaagaucgugagcuacgagugggacuucggcgacggcaacaagagcaacgaggagaaccccgagcacagcuacgacaaggugggcaccuacaccgugaagcugaaggugaccgacgacaagggcgagagcagcgugagcaccaccaccgccgagaucaaggaccugagcgagaacaagcugcccgugaucuacaugcacgugcccaagagcggcgcccugaaccagaaggugguguucuacggcaagggcaccuacgaccccgacggcagcaucgccggcuaccagugggacuucggcgacggcagcgacuucagcagcgagcagaaccccagccacguguacaccaagaagggcgaguacaccgugacccugagagugauggacagcagcggccagaugagcgagaagaccaugaagaucaagaucaccgaccccguguaccccaucggcaccgagaaggagcccaacaacagcaaggagaccgccagcggccccaucgugcccggcauccccgugagcggcaccaucgagaacaccagcgaccaggacuacuucuacuucgacgugaucacccccggcgaggugaagaucgacaucaacaagcugggcuacggcggcgccaccugggugguguacgacgagaacaacaacgccgugagcuacgccaccgacgacggccagaaccugagcggcaaguucaaggccgacaagcccggcagauacuacauccaccuguacauguucaacggcagcuacaugcccuacagaaucaacaucgagggcagcgugggcagauga

SEQ ID NO: 5220 - RNA, 3027 nt, Artificial Sequence
  derived and/or modified CDS sequence (opt5) from Clostridium histolyticum__BAA77453.1__ColG(111-1118)
auugcuaacacaaauuccgagaaauaugacuuugaauaccuuaacggccugucuuauacggagcucaccaaucugaucaagaacauuaaauggaaucagaucaacgggcuuuucaauuacagcacaggaucccaaaaguuuuucggcgauaaaaacagaguccaggccauuaucaaugcgcugcaggaaucugggcggaccuauacagcuaacgacaugaagggaaucgagaccuuuacagaaguucuccgcgccggcuucuaccugggguauuacaaugauggacugagcuaccucaacgacagaaauuuucaggauaagugcauucccgccaugaucgcuauucagaaaaacccuaauuucaagcugggcaccgccgugcaagacgaggugaucacgucccuuggcaaacugauugggaacgcuagcgccaacgcggaggucgugaauaacuguguuccggugcucaagcaguuucgggaaaaucugaaccaguaugcccccgauuacgucaaaggaaccgcugugaaugagcuuaucaagggcauugaguucgacuuuucuggggccgcuuaugaaaaggauguuaaaacaaugccuugguacggaaagaucgaccccuucaucaacgagcugaaagcccucggccuguaugggaauauuaccuccgcgacagaaugggccagcgaugugggaaucuacuaucugucuaaguucggccucuacuccaccaaccgcaaugacauuguccaaagccuggagaaagcuguggauauguacaaguauggcaaaaucgccuuuguggcuauggaaagaauuacgugggacuacgacgggaucggaucuaacggcaagaaggucgaucacgacaaauuccuugaugacgccgagaagcauuaucugccuaaaacauacaccuuugauaaugggacauucaucauucgggccggagacaagguuuccgaagagaaaaucaagcgccucuauugggcuagcagagaggugaagucccaguuucaccggguggucggcaacgauaaagcgcuggaaguggggaaugccgacgauguucuuaccaugaagauuuucaacucucccgaggaauacaaauuuaauaccaacaucaacggagugagcacagacaauggcggccuguauauugagccucgcgggacguucuacaccuacgaaagaacaccgcagcaguccaucuuuagccucgaggagcuguuccggcaugaauauacccacuaccugcaagcucgcuaucucgucgauggacuguggggccaggggcccuuuuacgagaagaacagacuuacaugguucgacgaaggaaccgccgaguuuuucgccggcucuacgcggacauccggggugcugccucgcaaaagcauccucggcuaucuggcuaaggacaagguugaucauagauacucucuuaaaaagacccugaauagcggauaugacgauuccgacuggauguucuacaacuacggcuuugccguggcgcacuaucucuacgaaaaagauaugcccaccuucauuaagaugaauaaagcuauccugaacacagacgucaagucuuaugaugagauuaucaagaaacugagcgacgaugccaauaagaacaccgaguaccagaaucacauucaagaacucgccgacaaauaucagggggcuggaaucccucugguguccgaugacuaccuuaaggaucauggcuauaaaaaggccagcgaggucuacucugaaauuuccaaagcugccagccugacaaacacgucugugaccgcggagaagucccaguacuuuaauacauucacccuccgggggacauauaccggagagacgagcaagggcgaauuuaaagacugggacgagauguccaagaaacuggaugggacccuggaaucucuugccaagaacagcugguccggcuacaaaacacucaccgcuuauuucacaaauuacagaguuaccucugacaacaaggugcaguaugaugucguguuucacggaguucugacggacaaugccgauaucagcaacaacaaggcucccaucgccaaagugacaggcccguccaccggggcggucggacgcaauauugaguucagcggcaaggacucuaaagaugaagacgggaagaucguguccuacgauugggacuuuggagauggcgccacaagccgggggaaaaacucugugcaugcuuauaagaaggccggcaccuacaauguuacccugaaagucacagacgauaagggagcuacggccaccgaguccuucacaauugagaucaaaaacgaagacaccacaaccccuauuacgaaggagauggaacccaaugacgauaucaaagaggccaacggcccuaucguggaaggggugacagucaagggagaccucaauggcagcgaugacgcugauaccuuuuacuucgacgugaaggaggauggggacguuaccauugagcugcccuauucuggaagcuccaacuuuacauggcuuguguacaaagaaggcgaugaccaaaaucacaucgcgagcgggauugauaagaacaauucuaaagucggcaccuucaaguccacaaaaggaagacacuauguguucaucuacaagcaugacagcgccuccaacauuucuuauagccugaauaucaaaggccucgggaacgagaagcugaaggaaaaagagaauaacgacuccucugauaaggcuacgguuauccccaacuuuaauaccacaaugcagggaagccugcuuggcgacgauucccgcgacuacuauucuuucgaagugaaagaggagggggaagucaacauugagcucgauaagaaagacgaauuuggagugaccuggacacugcacccugagagcaauaucaacgaucggauuaccuacggccagguugacggcaauaagguguccaacaaggucaaacugagaccggggaaguacuaucuccugguguacaaauauagcggaucuggcaauuacgagcuucgcgugaacaaguga

SEQ ID NO: 5221 - RNA, 3375 nt, Artificial Sequence
  derived and/or modified CDS sequence (opt5) from Clostridium histolyticum__BAA77453.1__ColG(1-110)_CS-F_ColG(111-1118)
augaaaaagaacauucuuaaaauccugauggacuccuauucuaaggagagcaaaauucagacagucagacggguuacguccgugucucuccuggcuguguaccuuaccaugaauacaagcucccugguccucgccaagcccaucgaaaacaccaaugauacaagcauuaagaacguggagaaacugcgcaaugcgccuaacgaagaaaauucuaagaaaguugaagacuccaagaacgauaaaguggagcacgucaagaauaucgaggaagcuaagguggagcaaguugccccggaagugaaaagcaagucuacccugagauccgccagccggcgcagacggaaacgcaucgcuaacacaaauucugagaaguaugacuuugaguaccucaacggccuguccuauaccgaacuuacgaaucugauuaaaaacaucaaguggaaucagauuaacggacucuucaacuacagcaccggaucccagaaauuuuucggcgauaagaauagaguccaggccaucauuaacgcucugcaagagucugggcggacauauaccgccaaugacaugaagggaaucgaaacauuuaccgaggugcuucgcgcgggcuucuaccugggguacuauaacgauggacucagcuaccugaaugacagaaacuuucaggauaaaugcauucccgccaugaucgcuauccagaagaauccuaacuucaaacugggcacggccgugcaggacgaagucauuacaucccucggcaagcugaucgggaaugcuagcgccaacgcggagguugugaauaacugugugcccguccuuaaacaauuucgggagaaucugaaccaguaugccccugauuacgugaagggaaccgcuguuaaugaacucauuaagggcaucgaguucgacuuuucuggggccgcuuaugaaaaagaugugaagacaaugcccugguacggaaaaauugacccuuucaucaacgagcugaaggcccuuggccuguaugggaacaucaccuccgccaccgaaugggcuagcgacgucggaauuuacuaccucucuaaauucggccuguauagcacaaaucgcaacgauaucgugcagucccuggagaaggcgguugacauguacaaguauggcaaaauugccuuuguggcuauggagagaaucacgugggauuacgacgggauuggaucuaauggcaagaaagucgaucaugacaaguuccucgaugacgccgaaaaacacuaucugccgaagaccuacacauuugauaacgggaccuucaucauccgggccggagacaaggugagcgaggaaaagauuaagcgccuuuauugggcuuccagagaggucaaaagccaguuucaucgggugguuggcaaugauaaggcccuggaaguggggaacgcggacgacguccucacaaugaaaaucuucaauucucccgaggaguacaaguuuaacaccaauauuaacggaguguccacggauaauggcggccuguacaucgaaccuagagggacauucuauaccuacgagcgcacaccccaacagagcauuuuuagccuugaggagcuguuccggcacgaguauacccauuaccuccaggcuagauaucugguugacggacuguggggccaagggccuuuuuacgagaaaaaccgccucaccugguucgaugaaggaacagccgaauuuuucgccggcuccacgcggaccagcggggugcugcccagaaaguccauccuuggcuaucuggcuaaggacaaagucgaucaccgcuacucucucaagaaaacacugaauagcggauacgacgauuccgacuggauguucuauaacuacggcuuugccguggcucacuaucuguacgagaaggauaugccgaccuucauuaaaaugaauaaggccauccuuaacacagacgugaagucuuaugaugaaaucauuaaaaagcucagcgacgaugcgaacaaaaauaccgaguaccagaaccauauccaggagcuggccgacaaguaucagggggcugggauuccucugguuuccgacgauuaccucaaagaccacggcuacaagaaggccagcgaagucuauucugagaucuccaaagcugccagccugacgaauaccucugugacagcggaaaagucccaauacuuuaacaccuucacacuucgggggaccuauacgggagagacaagcaaaggcgaauuuaaggauugggacgagaugucuaaaaagcuggaugggacccucgagagccuggccaaaaauuccuggagcggcuacaaaacacugaccgcuuauuucaccaacuacagagugacaucugacaauaagguccaguaugaugugguuuuucauggagugcuuacggacaacgccgauauuuccaauaacaaagcucccaucgccaaggucaccggcccuagcacaggggccgugggacgcaauaucgaguucuccggcaaagacucuaaggaugaagacgggaaaauuguuagcuacgauugggacuuuggagacggcgcuaccucccgggggaagaacucugugcacgcguacaagaaagccggcacauauaaugucacccucaaggugacggaugacaaaggagcuacagccaccgaaucuuucaccaucgagauuaagaacgaagauacaaccacacccaucacgaaagagauggagcccaaugacgauauuaaggaagccaacggcccuaucguugagggggugaccgucaagggagaccugaacggcuccgaugacgcugauacauuuuacuucgacgugaaagaagauggggacgugaccaucgagcugccguauucuggaagcuccaauuuuacauggcucgucuacaaggagggcgacgaucagaaccacauugccagcgggaucgacaaaaauaacucuaagguuggcaccuucaaauccacgaagggaagacauuauguguucauuuacaagcacgauagcgcgucuaauaucuccuauagccugaacauuaaaggccuugggaaugaaaagcugaaagagaaggaaaacaaugacucuuccgauaaagcuaccgugauccccaacuuuaauacaaccaugcagggaagccuccugggcgacgauucccgcgacuacuacagcuucgaggucaaggaagagggggaggugaacaucgaacuggauaagaaagacgaguuuggaguuacauggacccuucauccugaaucuaauauuaacgaucggaucacauauggccaaguggacggcaauaaggucagcaacaaagugaagcucagacccgggaaauacuaucugcugguuuacaaguauuccggaucuggcaauuacgagcuccgggugaacaaguga

SEQ ID NO: 5222 - RNA, 2946 nt, Artificial Sequence
  derived and/or modified CDS sequence (opt5) from Clostridium histolyticum__BAA34542.1__ColH(41-1021)
guccagaacgaguccaaaagauauacaguuucuuaccuuaagacgcugaauuauuacgaccucguggaucugcuugugaaaaccgaaauugagaaccugcccgaccucuuucaauauagcuccgaugcuaaggaguucuacggcaauaaaacacggaugucuuuuaucauggacgaaauugggcgcagagccccucaguauaccgaaaucgaucacaagggcauuccgacacuggucgaggugguucgggcgggauucuaccugggguuucauaacaaggagcucaaugaaaucaacaaacgcagcuucaaggagagagugauccccuccauucuggcuauccagaaaaauccuaacuuuaagcugggaaccgaaguccaggacaaaauugugagcgccacaggccugcucgccgggaaugagaccgcucccccugagguugugaacaauuucacgcccauccugcaagauugcauuaagaacaucgaccgguacgcccuugaugaccugaagucuaaagcucucuuuaauguccuggccgcgccuaccuaugauauuacagaauaccugcgcgccaccaaggagaaaccggaaaacacacccugguauggaaagaucgacggcuucaucaaugagcucaaaaagcuggcucuuuacggcaaaauuaacgauaacaauuccuggaucauugacaacgggaucuaucacauugccccucugggaaagcuccauagcaauaacaagaucggcaucgaaacccugacggaggugaugaaaguguaccccuaucuuucuaugcagcaccuucaguccgcugaccagauuaagagacauuacgauagcaaagacgccgaggggaauaagaucccucucgauaaauuuaagaaggaaggaaaagagaaguacugucccaaaacauauaccuucgacgauggcaaggucauuaucaaagcgggggcccggguugaagaggaaaaggugaagcgccuguacugggcuucuaaagaggugaacucccaauucuuuagagucuauggaauugacaagccgcuggaggaaggcaauccugaugacauccucacaauggugaucuacaacagccccgaggaauauaaacuuaauuccguucuuuacggcuaugauaccaacaaugggggaauguacauugagccugaaggcaccuucuuuacauacgagcgggaggcccaggaaucuacguauacccuggaggaacucuuccgccacgaguacacacacuaucugcaggggagauacgcugugcccggacaguggggccggaccaagcuguaugacaacgaucgccugacaugguacgaggaagggggagccgagcucuuugccggcagcaccagaacguccggcauccugccccggaaaagcauugucucuaauauccauaacacaaccagaaauaaccgcuauaagcuguccgacaccgugcacagcaaguacggggcuucuuucgaauuuuacaacuaugcgugcauguucauggacuacauguauaauaaagauaugggcauucucaacaagcugaaugaccuugccaaaaacaaugauguugacggauacgauaacuauauccgggaccugagcuccaauuacgcucucaacgauaaguaucaagaccauaugcaggagagaauugauaauuacgaaaaccugacagugccuuuugucgccgacgauuaccuggugcgccacgccuauaaaaauccgaacgagaucuacucugagaucagcgaagucgcuaaacuuaaggacgccaaguccgaggugaagaaaagccaguauuucucuaccuuuacacuccggggguccuacacgggaggcgcgagcaaggggaaacuggaagaucaaaaggcuaugaauaaauucauugacgacucucugaagaagcucgauaccuauuccuggagcggcuacaaaacacugaccgccuauuuuacaaacuacaagguugacuccucuaauagagugaccuacgaugucguguuccacggauaucuucccaacgagggcgacagcaaaaacucccugccuuacgggaagaucaauggaacguauaaaggcaccgaaaaggagaagauuaaauucucuagcgagggguccuuugaucccgacggaaagaucguuagcuacgaaugggauuucggcgacgggaacaaaucuaaugaggaaaacccugagcauuccuaugauaaggugggcacauacaccgucaaacucaaggugacagacgauaagggagaaagcucuguguccaccacgacagccgagauuaaagaccugagcgagaauaagcugcccguuaucuauaugcacgucccgaaaucuggcgcucuuaaccagaaggugguguuuuacgggaaaggaaccuacgauccugacggcagcaucgccggguaucagugggacuucggagauggcuccgacuuuagcucugaacagaaucccucccaugucuacacaaagaaaggggaguauaccgugacccuccgcguuauggauagcuccggccaaaugucugaaaagacaaugaagauuaaaaucacggacccuguguaccccauuggaaccgagaaggagccuaacaauagcaaagaaacagcuuccggccccaucgucccggggauuccugugucuggaaccaucgagaacacaagcgaucaggacuauuucuacuuugauguuaucacccccggcgaagugaagauugacaucaauaaacugggguauggaggcgccacgugggucguguacgaugagaacaauaacgcgguuuccuacgccacagacgaugggcagaaucugucuggcaaguucaaggcugacaaacccggacgguauuacauucaccucuauauguuuaacggcagcuacaugccuuauagaaucaacauugaaggguccgugggacgcuga

SEQ ID NO: 5223 - RNA, 3084 nt, Artificial Sequence
  derived and/or modified CDS sequence (opt5) from Clostridium histolyticum__BAA34542.1__ColH(1-40)_CS-F_ColH(41-1021)
augaaaagaaagugccuuuccaaacggcugaugcucgcuauuacaauggccacgaucuuuaccgucaacucuacacugcccauuuaugcggcuguugacaagaauaacgccaccgccgcucgcagacggcgcaaaagagugcagaaugagagcaagcgguacacaguguccuaucuuaagacccugaacuacuaugaucucgucgaccugcuggugaaaacagaaaucgagaaucucccugaucuguuccaauacucuagcgacgccaaggaauuuuauggcaacaaaacccgcauguccuucauuauggaugagaucgggagacgggcuccgcaguacacggaaaucgaccacaagggcauucccacccuuguugaggugguccgcgccggauuuuaccugggguuccauaauaaagagcucaacgaaaucaauaagagauccuuuaaggagcgggugauuccuucuauccuggcgauucagaaaaaccccaauuucaaacuuggaacagaaguucaggauaagaucguguccgccaccggccugcucgcugggaacgagacagccccucccgaggucgugaauaacuuuaccccuauucugcaagacuguaucaagaauaucgaucgcuaugcucuggacgaucucaaaagcaaggcccuguucaacgugcuugcggccccgacguacgacauuacagaauaucugagagcuaccaaagagaagcccgaaaacacaccuugguacggaaagaucgauggcuuuauuaaugagcucaaaaagcuggcccuuuauggcaaaaucaacgacaauaacucuuggauuaucgacaaugggaucuaccacauugcuccccugggaaagcuccauuccaacaauaaaaucggcauugaaacccugaccgaggucaugaagguuuauccuuaccugagcaugcagcaccuccagucugccgaucagaucaagcggcauuacgacuccaaagaugccgaggggaacaagauuccccuggacaaauucaagaaagaaggaaaggagaaguauugcccgaaaacauacacguucgaugacggcaaggugaucaucaaagcuggggcgcgcguggaagaggaaaaggucaaaagacuuuauugggccagcaaggaggugaauagccaauuuuuccggguuuacggaauugauaagccucuggaggaaggcaaccccgacgauauccucaccauggugauuuauaauucuccugaggaauacaaacugaacagcguccuuuauggcuacgacacaaauaacgggggaauguacaucgagcccgaaggcaccuuuuucacauaugagagagaggcucaggaauccaccuacacgcuggaggaacucuuucgccacgaguauacacacuaccugcaggggcgguaugccgugcccggacaguggggcagaaccaagcuguacgauaaugaccgccucaccugguaugaggaagggggagccgagcuguucgcuggcagcacacggaccucuggcauucuuccuagaaaauccaucguuagcaacauucauaacacaacgcgcaauaaccgguacaagcugucugacaccgugcacagcaaauacggggccuccuuugaguucuauaauuacgcguguauguuuauggauuauauguacaacaaggacaugggaauccucaauaaacugaacgaucuggcuaagaauaacgacgucgauggcuaugacaauuacaucagagaucuuucuagcaacuaugcccucaaugacaaguaccaagaucauaugcaggaacgcauugacaacuacgaaaaucugacagugccguucgucgccgaugacuaucuggugcggcacgcuuacaaaaaccccaaugagaucuauuccgagauuagcgaaguugccaagcucaaagaugcuaagucugaggugaaaaagucccaguacuuuagcaccuucacacugagagggucuuauaccggaggcgccuccaaggggaaacuugaagaccaaaaggcgaugaacaaauuuaucgacgauagccugaagaaacucgacacguacuccuggucuggcuauaagacccugacagccuacuucaccaacuacaaggucgauagcuccaaucgcgugacauaugacguuguguuccacggauaccugccuaacgagggcgauucuaaaaauagccuucccuaugggaagauuaacggaaccuacaaaggcacggaaaaggagaaaaucaaguuuuccagcgaggggucuuucgacccugauggaaagaucgucuccuaugaaugggacuuuggcgaugggaauaaaagcaacgaggaaaaucccgagcauucuuacgacaaggugggcacauauaccgugaaacucaagguuacagaugacaaaggagaauccagcgucucuaccaccacagcugagauuaaggaucugagcgagaacaaacugccggugaucuacaugcacgugccuaaguccggcgcccucaaucagaaggucguguucuacgggaaaggaacguaugaccccgacggcagcauugcuggguaccagugggauuuuggagacggcucugauuucuccagcgaacagaacccuucccauguuuauaccaagaaaggggaguacacagugacccugcgggucauggacucuagcggccaaauguccgaaaagacaaugaaaaucaagauuaccgaucccguguauccuaucggaacggagaaggagcccaauaacucuaaagaaacagccagcggcccgaucguuccugggauucccguguccggaaccaucgagaauaccucugaccaggauuacuuuuauuucgacgucauuacacccggcgaagugaagaucgauauuaacaaacuuggguacggaggcgcgaccuggguuguguacgacgagaauaacaacgccgucagcuaugcuacagaugacgggcagaaucuguccggcaaguuuaaagccgacaagccuggaagauacuauauccaccucuacauguucaacggcagcuauaugccguaccggaucaauauugaagggucugugggacgcuga

SEQ ID NO: 5224 - RNA, 3027 nt, Artificial Sequence
  derived and/or modified CDS sequence (opt6) from Clostridium histolyticum__BAA77453.1__ColG(111-1118)
auagcaaauacaaauuccgaaaaauaugacuucgaauaccuaaacggucuuaguuacacagaauuaacuaaccuaauuaaaaacauaaaauggaaucaaauaaauggcuuauuuaauuauucaacagguagucaaaaauucuucggagauaaaaacagagugcaagcaauaauaaacgcccuacaagagucaggacgaacauauacagcaaaugacaugaaaggaauagagacauucacagagguauuacgugccggauucuaccuaggauacuacaacgacgguuuaucuuacuuaaaugacagaaacuuccaggauaaauguauaccagcaaugauagcaauacagaaaaacccuaauuucaaacucggaacggcgguucaagacgaaguaauuacaucuuuagguaaauugauaggaaacgcaucagcgaacgccgagguaguaaacaauugcguaccgguccuuaaacaauuuagagaaaaucuaaaccaauaugcaccagacuacgugaaaggaacagcagugaaugaauuaauaaaaggcauugaguucgacuucucaggagcagcauaugaaaaagauguaaaaacaaugccaugguacggaaaaauagauccauucauaaaugaacuaaaagcauuaggauuauacggcaacaucaccagugcaacugaaugggcaucagaugucgggauauacuauuuaucaaaauucggacucuauagcacaaaccgaaacgacauaguacaaucacuagagaaagcaguagacauguacaaauacgggaaaauagcauuuguagccauggaacgaauuacaugggacuacgauggcauagguagcaauggaaagaaaguagaucacgauaaauuccuugacgacgcagaaaaacacuaucuuccuaaaacauacacuuuugauaacgguaccuucauaauacgagccggugauaaaguaagcgaagagaaaauaaaaaggcuauauugggcaagcagagaagucaaaagccaauuucauagaguaguaggaaaugacaaagcacuagaaguuggaaacgcugacgauguucuaacaaugaaaaucuucaacucaccugaagaauacaaauucaacacaaacauaaauggaguaaguaccgacaacggaggauuauauauagaacccagggggacguuuuauaccuacgagagaaccccucaacaaucuauauuuuccuuagaagaauuauuucgacaugaauacacacacuauuuacaagcacgauauuugguagauggacuauggggacaaggaccauuuuaugagaaaaacagacuuacgugguucgacgaaggaacggcagaguucuuugcaggaaguacaagaacaaguggaguauuaccaagaaaaucaauacuagguuacuuagcaaaagacaaaguagaucacagauacagccuaaagaaaacacugaauagcgguuaugaugacagugauuggauguucuauaauuacggauucgcaguagcucacuaucuauaugaaaaagauaugccaacauucaucaaaaugaauaaagcaauacuuaacaccgacguuaaaucauaugacgaaauaauaaagaaauuaagugacgacgcaaacaaaaauaccgaauaccaaaaccacauccaagaacuagcagacaaauaucaaggugcaggaauaccauuaguaucagacgacuaccucaaagaccauggauacaagaaagcguccgaaguauacucagaaauaaguaaagcagcaucauugacuaauacuucaguaacagcagaaaaaucacaauacuuuaacacauucacacuucgcggaacauauacgggagaaaccucaaaaggugaauuuaaagauugggacgaaaugaguaaaaagcucgacggcacucuagaaucauuggcuaaaaacuccuggucaggauauaaaacacuaacagccuacuucaccaauuacagagucaccucagauaauaaaguacaauaugacguaguauuucauggagucuuaacagacaacgcugauauaaguaacaauaaagcgccuauagcgaaaguaacaggaccaucaacgggagcaguaggaagaaauauugaguucucaggaaaggauagcaaagacgaagacggaaaaauuguaucuuaugauugggauuucggagauggagcaaccucaagagggaaaaacagugugcaugccuacaagaaagcaggaacuuauaauguaacacuaaaagugacagaugacaaaggagcgacagcaacagagagcuucacgauugaaauuaaaaacgaagauacuacaacacccauaacaaaagaaauggaaccaaaugaugacauaaaagaagcaaacggaccgauaguggaaggcguaacgguaaaaggagacuuaaauggaagugaugacgccgacacauuuuacuuugauguuaaagaagacggugaugucacaauagaauuacccuacucugguaguuccaacuucacuugguuaguauacaaagaaggagaugaucaaaaucauauagcauccggaauagacaaaaacaauagcaaaguaggcacauuuaaauccacaaaaggacgucauuauguuuucauuuacaaacacgauagugcaaguaacauaaguuauucucuaaauauaaaaggacuagguaaugaaaaacuaaaagaaaaagaaaacaacgauagcagugacaaagcuacuguuaucccaaacuucaacaccacaaugcaaggcagcuuacucggagacgauucacgagauuauuacagcuucgaaguaaaagaagagggggaaguaaacauagaacuagauaagaaagacgaauuuggaguaacauggacacuacacccggaaucgaacauaaaugacagaaucacauauggacaaguagacggaaacaaaguaucaaauaaagucaaacuaagaccuggcaaauauuaccuauuaguguauaaauauucaggaucagguaauuacgaacugagagucaauaaauaa

SEQ ID NO: 5225 - RNA, 3375 nt, Artificial Sequence
  derived and/or modified CDS sequence (opt6) from Clostridium histolyticum__BAA77453.1__ColG(1-110)_CS-F_ColG(111-1118)
augaagaaaaacauacuaaaaauacucauggauuccuauagcaaagaaaguaaaauacaaacaguacggagaguuacaucaguaagucuauuagcaguauaccuaacaaugaauacaagcuccuuaguauuagcaaagccaaucgaaaacacaaacgauacgucaauuaaaaacguagaaaaauuacgaaacgcaccuaaugaagaaaacucaaagaaagucgaagacagcaaaaacgauaaagucgagcacgugaaaaauauagaagaagcaaaaguagaacaaguagccccagaaguaaaaaguaaaucaacucuaagaucugcuucacgcagacgacguaaacgaauagccaacacaaauucagaaaaauaugauuucgaauaccuaaacggguuaucauacacagagcuaacgaaucuaaucaaaaacauaaaauggaaccaaauaaauggccuauuuaauuauagcacaggaucccaaaaauucuucggcgacaaaaaucgaguacaagcaauaauuaaugcacuacaggaaucuggcagaacauauacugcuaaugacaugaaaggaauagaaacauuuacagaaguacucagagcaggauuuuauuuagguuauuauaaugacggcuuaaguuaccuaaaugauagaaacuuucaagauaaaugcauaccugcaaugaucgcaauacagaaaaacccaaacuuuaaacuagggacagcgguacaagacgaaguaauaaccagcuuaggaaaacucaucggaaacgcuucugcaaacgcggaaguuguaaacaacugcguaccaguacuaaaacaauuccgagaaaaccuaaaucaauacgcuccagauuauguaaaaggaacggcuguaaacgaauuaauaaaagguaucgaauuugauuucagcggcgcagccuaugaaaaggacgucaaaacgaugccaugguauggaaaaauagacccauucauaaaugaacugaaagcacucggacuuuacgguaauauaacaagugcuacagaaugggcaucagacguaggaauauauuauuuaucaaaauucggauuauacucaacaaauagaaaugacauaguacaaagucuagaaaaagcggucgacauguacaaauauggcaaaauagcauuuguagcuauggaacgcauaacaugggacuaugauggaauagguucuaacgguaagaaaguugaucaugauaaauucuuagaugacgcagaaaaacacuacuuaccaaaaacauauacauucgacaacggcaccuuuauaauacgugccggagacaaaguuagugaagagaaaauuaaacgacuauacugggcuucgagagaaguaaaaucucaauuucacagagucgugggaaacgauaaagcacuagaaguuggaaacgcagaugauguccucacaaugaaaaucuuuaauuccccggaagaauacaaauuuaauacgaauaucaacggcgugucaacugauaauggaggacuguauauagaaccacgaggaacauucuacacuuaugaaagaaccccgcaacaaagcauuuucucccuagaagaacuauucaggcaugaauauacacauuaccuccaagccagauaccuaguugauggacuauggggacaaggaccguuuuacgagaaaaaucgauuaaccugguuugaugaaggaacggcagaguucuuugcaggaucaacaagaacaagcggaguacuaccaagaaaauccauacuagguuacuuagcaaaagauaaaguugaccacagauauaguuuaaagaaaacccucaacagugguuacgaugauucggauuggauguuuuacaacuacggauucgcaguugcgcacuacuuauacgaaaaagauaugccaacguucauaaaaaugaacaaagcaauacuaaauacugaugucaaaagcuacgaugaaauaauaaagaaacuaagugacgacgccaauaaaaauacagaauaccaaaaccauauacaagaacuagcugacaaauaccaaggugcgggaauaccucuaguaagugacgacuaucuaaaagaucauggauauaagaaagcaucagaaguuuacucugaaaucagcaaagccgcaucauuaacaaacaccucaguaacagcugaaaaaucacaauauuucaacacauucacacuaagggguacauauacaggcgaaaccaguaaaggagaauuuaaagauugggacgaaaugagcaagaaauuagauggaacucuagaaucuuuagccaaaaacucuuggucaggauacaaaacauuaacggcauauuucacgaacuauagaguuacaagugauaauaaagugcaauaugacguaguauuucacggaguccucacagauaacgccgauauuucaaauaauaaagcuccgauagcuaaaguaaccgguccauccacaggagcaguaggcagaaacauugaguucucugguaaagauaguaaagaugaagauggaaaaauagucucauacgacugggauuucggagauggagcaacaucaagagggaaaaacucaguacaugccuauaagaaagcgggaaccuauaacguaacccuaaaagucacagaugacaagggagcaacggcuacagaaaguuuuacaaucgaaauuaaaaaugaagacacaacaacaccaauaacgaaggaaauggaaccaaacgacgacaucaaagaagcuaacggaccaauaguugaaggaguaacaguuaaaggagauuuaaacggaucagaugaugcggacacuuuuuacuucgaugucaaagaagauggagacgucaccauugaauuaccuuauucaggaagcaguaacuucaccugguuaguauauaaagaaggagacgaucaaaaccacaucgcuagcggcauagauaaaaauaauucaaagguuggaaccuuuaagucaacaaaaggaagacacuauguauuuaucuacaaacaugauuccgccucaaacauauccuauagccugaauaucaaaggccuaggaaacgaaaaauuaaaagaaaaagaaaauaacgacagcucagauaaagcaacaguaauuccuaacuuuaacacuacaaugcaagguagccuauugggugacgauaguagagacuauuacagcuuugaagucaaagaagaaggagaaguuaauauagaacuagacaagaaagaugaguuuggaguaaccuggacauugcacccugaauccaauauaaaugacagaauuacuuauggccaagucgacggaaauaaagucucaaacaaagugaaacuaagaccggguaaauauuaccuuuugguguacaaauauaguggcucaggaaacuaugaauuaagggucaacaaauga

SEQ ID NO: 5226 - RNA, 2946 nt, Artificial Sequence
  derived and/or modified CDS sequence (opt6) from Clostridium histolyticum__BAA34542.1__ColH(41-1021)
guacagaacgaaucaaaaagauacacaguaaguuacuuaaaaacguuaaacuacuacgaccuaguagauuuauuagucaaaaccgaaauugaaaauuuacccgaccuuuuccaauacucuuccgaugcaaaagaauuuuacggcaauaaaacacgaaugagcuucauaauggaugaaaucgguagacgagcuccccaauacacagaaauagaccacaaaggaaucccuacauuaguugaaguaguuagagcaggauucuaccuagguuuucauaacaaggaauuaaaugaaauaaauaaacgaucauucaaagaacgaguaauaccaucaauacuugcaauacagaaaaacccaaacuuuaaacuuggaacugaaguucaagacaaaauagugucagcaacaggacuccuagcuggcaaugaaacagcuccaccagaaguaguaaacaacuuuacaccaauauuacaagauugcauuaaaaauauagaccgcuacgcuuuagaugaucuaaaaaguaaagcacuauuuaacguacuggcagcaccuacuuacgacauaaccgaauaccuacgagcaacaaaagaaaaaccugaaaacacccccugguacggaaaaauagacggauuuaucaacgaacuaaagaaauuagcacuuuauggaaaaauuaacgauaauaauuccuggaucaucgacaauggcauauaccauauagcuccacuaggaaaauuacacucaaacaacaaaauaggaauagaaacacuaacggagguaaugaaaguauacccauaucuaucaaugcaacaccuacaaucagccgaucaaauaaaaagacauuaugacucaaaagaugcagaaggcaacaaaauaccacuagacaaauucaagaaagaaggaaaagaaaaauauuguccgaaaacauacaccuuugaugauggaaaaguaauuauaaaagcuggagcaagagucgaagaagaaaaaguuaaacgauuauauugggcaucaaaagaaguaaauagucaauuuuuccgcgucuauggaauagauaaaccccuugaggaaggaaauccagacgacauccuaacaaugguaauauauaauucaccugaagaauacaaauuaaauucaguacuauauggauacgacacaaacaacggaggaauguacauagaaccagaagguacauucuuuacauaugagagagaagcacaagaaagcacauacacucuagaagaacuauucagacacgaguacacccacuaccuacaaggucgauaugcuguaccaggacaauggggaaggacaaaacuauacgauaaugacagacuaaccugguacgaagaaggaggagccgaacuauucgcaggaagcacacguacaucagguauacuaccaagaaaauccauagucagcaacauacauaacacgacacguaacaacagauacaaauuaagugacacaguucauagcaaauauggagcuucauuugaguuuuauaacuacgcauguauguucauggauuacauguacaacaaagacaugggaaucuuaaauaaacuaaacgauuuagcuaaaaauaaugauguagauggauacgacaacuauauacgcgauuuaagcaguaacuacgcacuaaacgauaaauaccaagaucacaugcaagaaaggauagacaacuacgaaaauuuaacagucccauucgucgcagacgauuaccuagucagacacgccuauaaaaauccuaacgaaauauacucagagauuagcgaggucgcaaaauuaaaagacgcaaaaagugaaguaaagaaaagucaauauuucaguacauuuaccuuaagaggcucauauacaggcggagcaaguaaaggaaaauuagaagaucaaaaagcaaugaauaaauucauugaugacagccuaaagaaauuagacacauacucauggucgggcuacaaaacccuuaccgcuuacuuuacaaacuauaaagucgacaguucaaacagggucacauacgacguuguauuccacggcuacuuaccaaaugaaggagacaguaaaaacucccuaccauacggaaaaauaaauggaacguauaaaggaacagaaaaagagaaaauaaaauucucaucagaaggaucauucgacccggacggaaaaauuguuuccuacgaaugggacuucggggacgguaacaaaucgaacgaagaaaauccugaacauucauaugauaaaguaggaacauacacaguaaaacuaaaagucacagaugacaaaggagaaucguccguaucuaccacaacagcggaaauaaaagauuuaucagaaaauaaacuacccguuauuuacaugcaugucccaaaaagcggagcauuaaaccaaaaaguaguauuuuacggaaaaggcacauaugauccagacggaucaauugccgguuaucaaugggacuucggagacggaagcgacuucaguagugaacaaaaccccucccauguauacacaaagaaaggugaauacacagucaccuuaagaguaauggacucaucaggacagaugagugagaaaacaaugaaaauaaaaauaaccgaccccgucuauccaauaggaaccgaaaaagaaccaaauaauucaaaagaaacagcaucaggaccaauaguacccggcaucccaguaucuggcaccaucgaaaacaccucugaucaagacuacuucuacuucgacguaauaacaccaggugaaguaaaaauugauaucaauaaacuaggauacggcggagcaacauggguaguuuacgacgaaaacaacaacgcaguuagcuacgcuacagaugacggacaaaaccuaagugggaaauuuaaagcagacaaaccuggaagauauuauauccaucucuacauguucaacgguucuuauaugccauauagaauaaacauagaaggcucaguaggaagauaa

SEQ ID NO: 5227 - RNA, 3084 nt, Artificial Sequence
  derived and/or modified CDS sequence (opt6) from Clostridium histolyticum__BAA34542.1__ColH(1-40)_CS-F_ColH(41-1021)
augaaaagaaaauguuuauccaaaagacuaaugcuagcuaucacaauggcuacaauuuucacagugaacucuacauuaccaauauacgcugcaguugauaaaaacaacgcaacagccgcuagaagaagaagaaaacgaguacaaaacgaaagcaaaagauacaccgucucuuacuuaaaaacacuaaauuacuacgaucugguagaccuucuaguaaaaacugaaauagaaaaucuaccagacuuauuccaauauucaagcgacgcaaaagaauuuuacggaaacaagacaagaaugaguuuuauuauggaugaaauuggacguagagcaccccaauacaccgaaauagaucacaaaggcauacccaccuuaguggaaguuguaagagccggguucuacuuaggauuucauaauaaagaauuaaaugaaauaaauaaacgauccuucaaagaaagagucauaccaagcauucucgcaauucagaaaaacccaaauuucaaacuaggaaccgaaguacaagauaaaauuguaucagcaaccggauuauuagcugguaacgaaacagcucccccugaaguaguaaauaacuuuacccccauauuacaagauugcauuaaaaauauagacagauacgccuuagacgaccuaaaaucaaaagcacuauucaauguccucgcugcuccaacauaugacauaacagaauaccuuagagcgacuaaggaaaaacccgaaaacaccccaugguaugguaaaauagaugguuucauaaacgaacuaaagaaacucgcacuauacggaaaaauaaacgacaacaauagcuggauaauagacaauggaauauaucauauagcaccauuaggaaaacuacauucaaacaauaaaaucggaauagaaacauuaacagaaguaaugaaaguauaucccuauuuaagcaugcaacaucuacagucugcggaccaaauaaaacgucauuacgacucuaaagacgcagaaggaaacaaaauuccacuagacaaauuuaagaaagaagggaaagaaaaauacugcccaaaaaccuacacuuuugaugauggaaaaguaauuauaaaagcuggagcacgcguagaagaagaaaaaguaaaacgauuauacugggccaguaaagaagugaauagucaauucuucagagucuauggaauugacaaaccucuagaagaaggcaacccagacgauauacuaaccaugguuauauauaauucuccagaagaauacaaacuaaauucaguauuauacggauaugauaccaacaacggagggauguacauagaaccugaagguacuuucuuuacauacgaaagagaagcacaagaaagcacauauaccuuagaggaacuauuuagacacgaauauacacacuaccugcaaggaagauaugcugugccaggacaauggggacguacuaaacuauacgacaacgauagacuaacaugguaugaagaaggaggagcagaacucuuugcuggcuccaccagaacaaguggaaucuuaccaagaaaaaguauaguaucaaacauacauaacacaacaagaaauaacagauacaaacucagcgacacaguacacucaaaauacggagcuagcuucgaauuuuauaauuacgcaugcauguucauggacuacauguacaacaaagauaugggaaucuuaaacaaacuaaaugaucuagcgaaaaauaaugauguugaugguuacgacaacuauauccgugaucucucaucaaacuacgcacugaacgacaaauaccaagaucauaugcaagaacguauagauaauuaugaaaauuuaacuguacccuucguagcagaugauuacuugguuaggcaugcauacaaaaauccuaaugaaauauacucagaaauaucugaaguagccaaacuaaaagaugcaaaaagugaaguuaagaaaagccaauauuuuuccacauuuacauuacgaggauccuauacuggaggggccaguaaagguaaacuagaagaccaaaaagcaaugaacaaauucaucgaugauucccuaaagaaauuagauacauauaguuggucaggcuacaaaacacuaacagccuauuuuacaaauuacaaaguagauucaagcaauagaguuacauacgacguaguauuccaugguuauuuaccaaaugaaggcgacaguaaaaauucauuaccauacggaaaaauaaauggaacauauaaaggaacggaaaaagagaaaauaaaauucuccucugaaggauccuuugacccagacggaaaaaucguuagcuacgaaugggacuucggugaugguaacaaaucaaacgaagaaaacccugaacacagcuacgacaaaguaggaaccuacacagucaaacucaaaguaacagaugauaaaggugaaucuucuguuucuacgacaacagcagaaaucaaagauuuauccgaaaacaaacucccagucauauauaugcacguaccaaaaucaggugcacuuaaucaaaagguuguauuuuauggaaaagguacauaugaucccgacggaucaaucgcaggauaccaaugggacuucggagacgggucagauuucuccucugaacaaaacccaagccacguauacaccaagaaaggagaauauaccguaaccuuacgagucauggauaguucaggucaaaugucagagaaaacaaugaaaaucaaaauaacugauccaguauacccaaucggaacagaaaaagaaccaaauaauagcaaagaaacagcaaguggacccaucgugccaggcaucccaguaucgggcacaauagaaaauacgagcgaccaagacuauuucuacuuugacgucauaacaccaggagaaguaaaaaucgauauaaauaaacuaggauacggaggagccacaugggucgucuacgaugaaaacaacaaugccgugagcuaugcaacagacgauggacagaaucuuucugggaaauucaaagcagauaaaccaggacgauacuauauacacuuauacauguuuaaugguaguuacaugccauaccgaauaaacauugaaggaagcguuggaagauga

SEQ ID NO: 5228 - RNA, 3027 nt, Artificial Sequence
  derived and/or modified CDS sequence (opt7) from Clostridium histolyticum__BAA77453.1__ColG(111-1118)
auugcaaacacuaauuccgagaaauaugacuuugaauacuugaacggccugaguuauaccgagcucacgaaucugaucaagaacauuaaauggaaucagaucaacggguuguucaauuacagcacugguucccaaaaguuuuucggcgauaaaaacaggguccaggccauuaucaaugcgcugcaggaaagcgggcggaccuauaccgccaacgacaugaagggcaucgagacuuuuaccgaagugcuccgcgcagguuucuaccugggguauuacaaugauggccuguccuaccucaacgacaggaauuuucaggauaagugcauucccgccaugaucgcaauucagaaaaacccaaauuucaagcugggcacggccguacaggacgaggugaucacuagcuuggggaaacugauugguaacgcgagcgccaacgcagaggucgugaauaacugugugccgguccucaagcaguuucgggaaaaucugaaccaguaugcccccgauuacgugaaaggcaccgccguaaaugagcugaucaaggggauugaguucgacuucuccggcgcagccuaugaaaaagaugugaagacuaugccaugguacgguaagaucgaccccuuuaucaacgaguugaaagcgcucgggcuguauggcaauauuaccagcgccaccgaaugggcaagugaugucggcaucuacuaucuguccaaguucgggcucuacagcacgaaccgcaaugacauugugcaaucccuggagaaagccguggauauguacaaguaugguaaaaucgcauuugucgccauggaaaggauuacuugggacuacgacggcaucgggaguaacggcaagaagguggaucacgacaaauucuuggaugacgccgagaagcauuaucugccaaaaaccuacacuuuugauaaugguaccuucaucauucgggcgggcgacaagguaagcgaagagaaaaucaagcgccucuauugggcauccagggaggugaagagucaguuucaccgggucguggggaacgauaaagcccuggaagugggcaaugccgacgauguccugaccaugaagauuuucaacagucccgaggaauacaaauuuaauacuaacaucaacgggguguccacggacaaugguggcuuguauauugagccacgcgggaccuucuacacuuacgaaaggaccccgcagcagagcaucuuuagucucgaggagcuguuccggcaugaauauacccacuaccugcaagcacgcuaucucguagauggccuguggggucagggccccuuuuacgagaagaacagguugacuugguucgacgaagggacggccgaguucuuugcgggcuccacccggacuagcggggugcugccacgcaaaagcauccucggcuaucuggccaaggacaaggucgaucauagguacucccugaaaaagaccuugaauagugguuaugacgauagcgacuggauguucuacaacuacggguuugcaguggcccacuaucucuacgaaaaagauaugcccaccuucauuaagaugaauaaagcaauccugaacacugacgucaaguccuaugaugagauuaucaaaaagcugagcgacgaugccaauaagaacacggaguaccagaaucacauucaagaacucgccgacaaauaucagggcgcagguaucccacuggugagugaugacuacuugaaggaucauggcuauaaaaaggccuccgagguguacagcgaaauuuccaaagcggccagucugaccaacacuagcguaaccgcagagaagucccaguacuuuaauacuuucacccuccgggggacguauaccggcgagacuagcaagggggaauuuaaagacugggacgagaugaguaagaaacuggauggcacccuggaauccuuggccaagaacagcugguccgguuacaaaacucugaccgccuauuucacgaauuaccgcgugaccagugacaacaagguccaguaugauguggucuuucacggggugcucacugacaaugcagauaucagcaacaacaaggcgcccaucgccaaagugaccggcccguccacuggcgcaguagggaggaauauugaguucagcgguaaggacaguaaagaugaagacggcaagaucguguccuacgauugggacuuuggggauggcgccaccagccgggguaaaaacuccguccaugccuacaagaaagcagggacguauaaugugacccugaaggucacugacgacaagggcgccaccgcgacugagagcuucaccauugagaucaaaaacgaagauacgaccacucccauuaccaaggagauggaaccaaaugacgauaucaaagaggccaacggccccaucguggaaggggugacuguaaagggugaccucaauggcagugaugacgcagauaccuucuacuuugacgucaaagaggauggggacgugacuauugagcugccauauagcggcuccaguaacuucaccugguugguguacaaggaaggugaugaccaaaaucacaucgccagcgggauugauaagaacaauuccaaagucggcacguuuaagagcaccaaaggcaggcacuauguguucaucuacaagcaugacuccgccaguaacauuagcuauucccugaauaucaaagggcucgguaacgagaagcugaaggaaaaagagaauaacgacaguagcgauaaggcaacugugauccccaacuuuaauaccacuaugcagggcucccuguugggggacgauagccgcgacuacuacaguuucgaaguaaaagaggagggcgaagucaacauugagcuggauaagaaagacgaauuuggugugaccuggacgcuccacccagaguccaauaucaacgaucggauuaccuaugggcaaguggacggcaauaaggucagcaacaaagugaagcugaggccgggcaaguacuaucuccugguauacaaauauuccgggagcgguaauuacgaguugcgcgugaacaaguga

SEQ ID NO: 5229 - RNA, 3375 nt, Artificial Sequence
  derived and/or modified CDS sequence (opt7) from Clostridium histolyticum__BAA77453.1__ColG(1-110)_CS-F_ColG(111-1118)
augaaaaagaacauuuugaaaauccugauggacuccuauaguaaggagagcaaaauucagacugucaggcgggugaccuccguaagccuccuggcaguguacuugacgaugaauacuuccagucugguccucgccaagcccaucgaaaacaccaaugauaccagcauuaagaacguggagaaacugcgcaaugcgccaaacgaagaaaauuccaagaaaguggaagacagcaagaacgauaaagucgagcacgugaagaauaucgaggaagccaaaguagagcaaguggcaccggaagucaagaguaaguccacucugaggagcgccucccggcgcaggcggaaacgcaucgcaaacaccaauagugagaaguaugacuuugaguaccucaacggccugagcuauacggaauugacuaaucugauuaaaaacaucaaguggaaucagauuaacggucucuucaacuacuccaccgggagccagaaauuuuucggcgauaagaauagggugcaggccaucauuaacgcgcugcaagagagugggcggacuuauaccgccaaugacaugaagggcaucgaaaccuuuacggaggugcugcgcgcagguuucuacuugggguacuauaacgauggccucuccuaccugaaugacaggaacuuucaggauaaaugcauucccgccaugaucgccauccagaagaauccaaacuucaaacugggcacugcaguccaggacgaagugauuaccagccucgggaagcugaucgguaaugccagugcgaacgccgagguagugaauaacuguguccccguguugaaacaauuucgggagaaucugaaccaguaugcaccagauuacgugaagggcacugccgucaaugaacucauuaaggggaucgaguucgacuucuccggcgcagccuaugaaaaagaugugaagaccaugcccugguacgguaaaauugacccauuuaucaacgagcugaaggcccugggguuguauggcaacaucaccagcgcgacugaaugggcaagcgacguaggcauuuacuaccucuccaaauucgggcuguauaguacgaaucgcaacgauaucgugcagagccuggagaaggccgucgacauguacaaguaugguaaaauugccuuuguggcaauggagaggaucaccugggauuacgacggcauuggguccaauggcaagaaagucgaucaugacaaguuccucgaugacgccgaaaaacacuaucugccgaagacuuacaccuuugauaacgguaccuucaucauccgggcgggcgacaaagugagcgaggaaaagauuaagcgcuuguauugggccaguagggaggugaaaucccaguuucaucggguaguggggaaugauaaggcacuggaagucggcaacgccgacgacgugcucacuaugaaaaucuucaauagccccgaggaguacaaguuuaacacgaauauuaacggggucuccaccgauaaugguggccuguacaucgaaccacgcgggacuuucuauaccuacgagaggacuccccaacagaguauuuuuagccuggaagaguuguuccggcacgaguauacccauuaccuccaggcaagguaucugguggacggccuguggggucaaggcccauuuuacgagaaaaaccgccucacgugguucgaugaggggaccgccgaguucuuugccggcuccacucggaccagcggggugcugcccaggaagaguaucuugggcuaucuggcaaaggacaaaguagaucaccgcuacucccucaagaaaacucugaauagcgguuacgacgauuccgacuggauguucuauaacuacggguuugccguggcgcacuaucuguacgaaaaggauaugccgaccuucauuaaaaugaauaaggccaucuugaacacggacgucaagaguuaugaugaaaucauuaaaaagcugagcgacgaugcaaacaaaaauaccgaguaccagaaccauauccaggagcucgccgacaaguaucagggcgccgguauuccccugguguccgacgauuaccucaaagaccacggcuacaagaaagcaagcgaagucuauagugagaucuccaaggcggccagccugacuaauaccuccgugacugcagaaaagagccaauacuuuaacaccuucacguugcgggggaccuauacuggcgagaccaguaaaggggaauuuaaggauugggacgagaugagcaaaaagcuggauggcacucucgagucccuggccaaaaauaguuggagcgguuacaagacccugacggccuauuucaccaacuacagggugacuuccgacaauaagguacaguacgaugucguguuucaugggguguugaccgacaacgcagauauuagcaauaacaaagccccaaucgcgaaggucacuggccccuccaccggcgccguggggcgcaauaucgaguucagugguaaagacagcaaggaugaagacggcaaaauuguguccuaugacugggauuuuggggacggcgcaacgagucgggguaagaacagcguacacgccuacaagaaagccgggaccuauaaugucacucugaaggugaccgaugacaaaggcgcaacugccaccgaauccuucacuaucgagauuaagaacgaagauaccacgaccccaaucacuaaagagauggagcccaaugacgauauuaaggaagcgaacggcccaaucguggagggggucaccgugaaaggugaccucaacggcagcgaugacgccgauacuuucuacuuugacguaaaggaagauggggacgugaccaucgagcugccguauaguggcuccagcaauuucacguggcucgucuacaaggagggugacgaucagaaccacauugcauccgggaucgacaaaaauaacagcaaggugggcaccuuuaaaaguacuaagggcaggcauuauguguucauuuacaaacacgauuccgccagcaauaucaguuacucccugaacauuaagggguuggguaaugaaaagcugaaagagaaggaaaacaaugacagcuccgauaaagcaaccgucauccccaacuuuaauacuaccaugcagggcagccugcucggggacgauagucgggacuauuacagcuucgaggugaaggaagagggcgagguaaacauugaacuggauaaaaaggacgaguuuggugugacguggaccuugcauccagaauccaauaucaacgaucgcaucacuuaugggcaagucgacggcaauaaggugaguaacaaagugaagcugaggcccggcaaauacuaucuccuggucuacaaguauagcggguccgguaacuacgagcuccgggugaauaaauga

SEQ ID NO: 5230 - RNA, 2946 nt, Artificial Sequence
  derived and/or modified CDS sequence (opt7) from Clostridium histolyticum__BAA34542.1__ColH(41-1021)
guccagaacgaguccaaaagguauacugugaguuacuugaagacccugaauuauuacgaccucguagaucuguuggugaaaacggaaauugagaaccugcccgaccucuuucaauauagcuccgaugcaaaggaguucuacggcaauaaaacucggaugagcuuuaucauggacgaaauugggcgcagggccccacaguauaccgaaaucgaucacaaggguauuccgacccuggucgagguggugcgggcgggcuucuaccugggguuucauaacaaggagcucaaugaaaucaacaaacgcuccuucaaggagagggucauccccaguauucuggccauccagaaaaauccaaacuuuaaguugggcacugaagugcaggacaaaauuguaagcgcaaccggucugcucgccgggaaugagacggcacccccagagguggucaacaauuucacucccauccugcaagauugcauuaagaacaucgaccgguacgcccuggaugacuugaaauccaaggcgcucuuuaaugugcuggccgcaccaaccuaugauauuacugaauaccugcgcgccaccaaggagaaaccggaaaacacccccugguauggcaagaucgacggcuucaucaaugagcucaaaaagcuggccuuguacgggaaaauuaacgauaacaauagcuggaucauugacaacgguaucuaucacauugcaccacugggcaagcuccauaguaauaacaagaucgggaucgaaacgcugacugaggugaugaaagucuaccccuaucuguccaugcagcacuugcagagcgccgaccagauuaagaggcauuacgauuccaaagacgcggagggcaauaagaucccacucgauaaauucaagaaggaagguaaagagaaguacugucccaaaaccuauacuuuugacgaugggaaggugauuaucaaagccggcgcacggguagaagaggaaaaggugaagcgccuguacugggccaguaaagaggucaacagccaauucuuuaggguguauggcauugacaagccgcuggaggaagggaaucccgaugacauccucaccauggugaucuacaacuccccagaggaauauaaacugaauagcgucuuguacgguuaugauaccaacaauggcgggauguacauugagcccgaaggcacuuucuuuacguacgagcgggaggcacaggaaaguaccuauacucuggaggaacucuuccgccacgaguacacccacuaucugcaggguagguacgccgugccaggccagugggggcggaccaagcuguaugacaacgaucgcuugacuugguacgaggaaggcggggccgagcucuuugcggguuccacgaggaccagcggcauccugccccggaaaaguauuguauccaauauccauaacacuacccgcaauaacagguauaagcugagcgacaccgugcacagcaaauacggggcauccuucgaauuuuacaacuaugccugcauguucauggacuacauguauaauaaggauaugggcauucucaacaagcugaaugacuuggccaaaaacaaugaugucgacgguuacgauaacuauauccgggaccugaguagcaauuacgcacucaacgauaaguaucaagaccauaugcaggagaggauugauaauuacgaaaaccugacugugccauuugucgccgacgauuaccuggugcgccacgcguauaaaaauccgaacgagaucuacuccgagaucagcgaaguggccaaguugaaagacgcaaagagugagguaaagaaaucccaguauuucagcacguuuacccugcggggcuccuacacugggggcgccaguaaggggaaacucgaagaucaaaaggcaaugaauaaauucauugacgacagccugaagaagcucgauaccuauuccuggagcggcuacaaaacucugaccgccuacuucacgaacuauaagguggacaguuccaauagggucaccuacgauguggucuuucacgguuauuugcccaacgagggggacagcaaaaacucccugccauacggcaagaucaaugguacuuauaaaggcaccgaaaaggagaaaauuaaguucaguagcgagggguccuuugaucccgacggcaagaucgugagcuacgaaugggauuucggggacggcaacaaaaguaaugaggaaaacccagagcauuccuaugauaagguggguacuuacaccguaaaacucaaggugacggacgauaaaggggaaagcuccgucagcaccacuaccgccgagauuaaggaccugagugagaauaagcugcccgugaucuacaugcacgucccgaaaagcggcgcauugaaccagaaggugguguuuuauggcaaagggacuuacgacccagaugguuccaucgccggcuaucagugggacuucggggauggcagugacuuuagcuccgaacagaaucccagccauguauacaccaagaaaggugaguauacggucacccugcgcgugauggauuccagugggcaaaugagcgaaaagacuaugaagauuaaaaucaccgaccccguguacccaauuggcacugagaaggagcccaacaauuccaaagaaaccgcgaguggcccaaucgucccggggauucccgugagcgguacgaucgagaacaccuccgaucaggacuauuucuacuuugaugugaucacuccaggcgaaguaaagauugacaucaauaaacucggguacggcggugccaccugggucguguaugaugagaacaauaacgcagugagcuacgccacugacgaugggcagaaucugaguggcaaguucaaagccgacaagcccggccgguauuacauucaccucuauauguuuaacggguccuacaugccauauaggaucaacauugaagguagcgucggccgcuga

SEQ ID NO: 5231 - RNA, 3084 nt, Artificial Sequence
  derived and/or modified CDS sequence (opt7) from Clostridium histolyticum__BAA34542.1__ColH(1-40)_CS-F_ColH(41-1021)
augaaaaggaagugcuuguccaaacggcugaugcucgcaauuacuauggccaccaucuuuacggucaacaguacucugcccauuuaugcggccguggacaagaauaacgcaaccgccgcacgcaggcggcgcaaaaggguacagaaugagagcaagcgguacaccguguccuauuugaagacucugaacuacuaugaucucgucgaccugcuggugaaaaccgaaaucgagaaucucccagaucuguuccaauacagcuccgacgccaaggaauuuuauggcaacaaaacgcgcaugaguuucauuauggaugagaucgggaggcgggcgccgcaguacacugaaaucgaccacaaggguauucccaccuugguggaggucgugcgcgccggcuuuuaccugggguuccauaauaaagagcucaacgaaaucaauaagaggagcuuuaaagagcggguaauuccauccauccuggcaauucagaagaaccccaauuucaagcugggcacugaagugcaggauaaaaucgucagcgccaccgguuugcucgccgggaacgagaccgcaccacccgagguggugaauaacuuuacgccaauucugcaagacuguaucaagaauaucgaucgcuaugcccuggacgaucucaaaaguaaggcgcuguucaacgucuuggccgcaccgacuuacgacauuaccgaauaucugagggccacuaaagagaagcccgaaaacaccccaugguacggcaagaucgauggcuucauuaaugagcucaaaaagcuggcacuguaugggaaaaucaacgacaauaacuccuggauuaucgacaaugguaucuaccacauugcccccuugggcaagcuccauagcaacaauaaaaucgggauugaaacccugacugaggugaugaagguauauccauaccuguccaugcagcaccuccagagugccgaucagaucaagcggcauuacgacagcaaagaugcggagggcaacaagauuccccuggacaaauuuaagaaagaagguaaggagaaguauugcccgaaaacguacaccuucgaugacgggaaggugaucaucaaagcaggcgcccgcgucgaagaggaaaaggugaaaagguuguauugggccuccaaggaggugaauagccaauuuuuccgggucuacggcauugauaaaccccuggaggaagggaacccagacgauauccucacuauggugauuuauaauagucccgaggaauacaagcugaacuccguacuguaugguuacgacaccaauaacggcgggauguacaucgagccagaaggcaccuuuuucacuuaugagcgcgaggcacaggaaagcacguacaccuuggaggaacucuuuaggcacgaguauacucacuaccugcagggucgguaugccgugcccggccagugggggaggaccaagcuguacgauaaugaccgccucaccugguaugaggaaggcggggcggagcuguucgccgguaguacucggacguccggcauuuugccaaggaaaagcaucgucagcaacauucauaacaccacucgcaauaaccgguacaagcuguccgacaccgugcacaguaaauacggggcgagcuuugaguucuauaauuacgccuguauguuuauggauuauauguacaacaaggacaugggcauccucaauaaacugaacgaucuggcaaagaauaacgacgucgaugguuaugacaauuacaucagggauuuguccagcaacuaugcccugaaugacaaguaccaagaucauaugcaggaacgcauugacaacuacgaaaaucucacugugccguucguggccgaugacuaucugguacggcacgcauacaaaaaccccaaugagaucuauagugagauuuccgaaguggccaagcucaaagaugcaaagagcgaggucaaaaagucccaguacuuuaguaccuucacgcugaggggcagcuauaccgggggcgccuccaaggggaaauuggaagaccaaaaggcaaugaacaaauucaucgacgauagccugaagaaacucgacacuuacaguugguccggcuacaagacccugacugccuauuuuaccaacuacaaaguggauagcuccaaucgggucacguaugacgugguguuccacgguuaccugccaaacgagggggauaguaagaauagcuugcccuauggcaagauuaacgguaccuacaaaggcacugaaaaggagaaaaucaaguuuuccagcgaggggaguuucgacccagauggcaaaaucguauccuaugaaugggacuuuggggauggcaauaagagcaacgaggaaaaucccgagcauuccuacgacaagguggguaccuacacugucaaacugaaggugaccgaugacaaaggggaaagcagugucagcacgaccacugccgagauuaaggaccucuccgagaacaaacugccggugaucuauaugcacgugccaaagaguggcgcacucaaucagaagguagucuucuacggcaaagggaccuaugaucccgacgguagcauugcgggcuaccagugggauuuuggggacggcuccgauuucagcuccgaacagaaccccagucauguguauacuaagaaaggugaguacaccgugacgcugcgcgucauggacagcuccgggcaaaugagugaaaagaccaugaaaaucaagauuacugauccaguguaucccaucggcaccgagaaagagccaaauaacagcaaggaaacugccuccggcccgaucgugcccgggauuccaguaagcgguaccaucgagaauaccagugaccaggauuacuuuuacuucgacgucauuacucccggcgaagugaagaucgauauuaacaaauugggguauggcggugcaacguggguggucuacgacgagaauaacaacgccguguccuaugccaccgaugacgggcagaaucugagcggcaaguuuaaagcagacaagccaggcagguacuauauccaccuguacauguucaacggguccuauaugcccuaccggauuaauaucgaagguagcguaggccgcuga

SEQ ID NO: 5232 - RNA, 3027 nt, Artificial Sequence
  derived and/or modified CDS sequence (opt8) from Clostridium histolyticum__BAA77453.1__ColG(111-1118)
auagccaacaccaacucagaaaaauacgacuucgaauaccuaaacggccuaagcuacaccgaacuaaccaaccucaucaaaaacauaaaauggaaccaaauaaacggccuauucaacuacagcaccggcagucaaaaguucuucggugacaagaaccgcguccaggcgauaaucaacgcccuacaagaauccggccgcaccuacacagccaacgacaugaaaggcauagaaacauucacggaaguacuacgugcuggauucuaucuaggcuauuauaacgacggacugagcuaccuaaacgacaggaacuuucaagacaaaugcauccccgccaugauagcaauccagaaaaaucccaacuuuaaacucggaacggcgguccaagacgaggugaucacgucacuuggaaaacucauaggaaacgcgagcgccaacgccgagguaguaaauaacugcguaccaguccugaagcaauuccgugaaaaucuuaaccaauacgccccagacuacguaaaaggaacugcggucaacgagcucauaaaaggaauagaguucgacuucagcggagccgcauaugaaaaagacguaaagaccaugcccugguacggcaaaauagacccguucaucaacgaacucaaggcacuaggccuauacggcaacaucacaagcgccaccgaaugggccucagacgucgggaucuacuaccuaucaaaauucggacucuacagcacaaaccgaaacgacaucguacaaucccuagaaaaagcagucgacauguacaaauacggaaagaucgcauucgucgccauggagcgcaucacgugggauuacgacggaauaggcucaaacggaaagaaagucgaccacgacaaauuccucgacgacgcagaaaaacacuaccugccgaaaacuuauacguuugacaacggcaccuucauuauccgcgcgggcgacaaaguaucugaggaaaagaucaaacgacuauacugggcuagccgagaaguaaaaagccaguuccaccgaguagucggaaacgauaaggcgcucgaaguaggaaacgccgacgacguccuuacuaugaagaucuucaacagccccgaagaauacaaauucaacacuaacaucaacggcguauccacagacaacggaggccuauacaucgaaccuaggggcaccuucuacaccuacgaacgcaccccacaacaaucaaucuucucucuugaagaacucuuccggcacgaguacacccacuaccuacaagcacgauaccucgucgacggccuauggggccaaggaccauucuacgagaaaaacagacucaccugguuugacgaagggaccgcugaguucuucgccggcagcacaagaacaucaggaguccucccccgaaagagcauccuaggauaccuggccaaggacaagguagaucaccgcuacagccuaaagaagacacuaaacagcggcuacgacgacuccgacuggauguucuauaauuacggcuucgcgguagcacacuaccuguaugaaaaagacaugccaaccuucaucaaaaugaacaaagcaauacuaaacaccgaugucaaaagcuacgaugaaauuaucaaaaagcugagcgacgacgcaaauaaaaacaccgaauaucaaaaccacauccaggaacucgccgacaaauaccaaggcgcagggaucccccuggugucagacgacuaccuaaaagaccacggcuacaagaaagccucggaagucuacuccgaaaucaguaaagcagccagccuaaccaauacaucaguuacagccgaaaagagccaguacuucaacacauucacacugaggggcaccuacacaggcgaaacuuccaaaggggaguucaaggacugggacgaaaugagcaagaagcucgacggcacccucgaaucacucgcuaaaaauucauggucgggauacaagacuuuaacggcauacuucacgaacuaccgagugacaagcgacaacaaaguccaauacgacgucgucuuucacggcguccugaccgacaacgcagacauauccaacaacaaagcaccgaucgcaaaagucaccggaccgagcaccggggcagucgggagaaacaucgaguucucaggcaaagacuccaaggacgaggacggcaaaaucgucagcuacgacugggacuucggagacggcgcaacaagccggggcaagaacucaguccacgccuacaagaaagcaggaaccuacaacguaacacuaaaaguaaccgacgacaaaggggcaacagccaccgaaucguucaccauagaaaucaaaaacgaagacaccaccacccccauuacgaaagagauggaaccgaaugacgacaucaaagaggcuaacggcccuaucgucgagggcguaaccguaaaaggcgaccuuaacggaucggaugacgcagacaccuucuacuucgacguaaaagaagauggcgacgucacuaucgagcucccauacuccggcuccagcaacuucaccuggcucguauacaaggaaggugacgaccagaaccacaucgcuucggggauagacaaaaauaacucuaaaguuggcacauucaagagcacaaaaggccggcauuacguuuucauauacaagcacgacuccgcuucaaacaucaguuacagccucaacaucaagggacugggaaaugagaagcucaaagagaaagagaacaacgacuccuccgacaaagccacgguaauacccaacuucaauacgaccaugcaagguucucuacucggcgacgacagcagggacuacuacucguuugaggucaaggaggaaggcgaaguaaacauagagcuugacaagaaagacgaguucggugugacguggacacuacacccagaguccaacauaaaugacagaauaacauacggccagguagacggcaacaaggugagcaacaaagucaaacuccgacccgguaaauacuaccuauuagucuacaaauacuccggaagcgggaacuacgagcuacgcgucaauaaguga

SEQ ID NO: 5233 - RNA, 3375 nt, Artificial Sequence
  derived and/or modified CDS sequence (opt8) from Clostridium histolyticum__BAA77453.1__ColG(1-110)_CS-F_ColG(111-1118)
augaagaaaaacauccucaaaauccuaauggauagcuacucaaaggaaaguaaaauccagacgguucgccgagugacguccgucucccuucuagcaguauaccucacuaugaacacaagcucccuaguccuggccaaacccauugaaaacaccaacgacaccucuauaaagaacguagaaaaacuccgaaacgccccaaacgaggaaaacucaaagaaaguagaggauucuaaaaacgacaaaguagaacacgucaaaaacauagaagaggccaaaguagaacaagucgccccggaagucaaauccaaaagcacgcugcggucggcgucucgccggcgacggaaacgcauagcaaacacaaacucggaaaaauacgacuucgaauaccucaacggacucagcuacaccgaacugacgaaccucaucaaaaacaucaaauggaaccaaaucaacggacuguucaacuacuccacaggaucccaaaaguucuucggcgacaaaaaccgaguacaggcgaucauaaaugcccugcaggaaagcggcagaacuuauaccgcaaaugacaugaagggcaucgaaacguucaccgagguccugagagcgggcuucuaccuaggauacuacaacgacggacucagcuaccucaacgaccgcaacuuucaggauaaaugcauaccggcaaugaucgcaauccagaaaaaccccaacuucaaacuuggaacagcgguacaagaugaggucaucacaucgcugggaaagcuaauaggaaacgccuccgcaaacgccgaaguagucaacaacugcgucccuguauuaaaacaauuccgugagaaccucaaccaauacgcccccgacuacgucaaaggcaccgccgucaacgaacugauaaagggcauagaguucgacuucaguggagcagcauacgaaaaagacgucaagaccaugcccugguacggcaaaaucgaucccuucaucaaugaacucaaagcgcuuggccucuacggaaacauaaccucugccacagaaugggcaagcgacgucggaauauauuaccuauccaaauucggccucuacagcacaaacagaaacgacauaguacagucacucgaaaaagcugucgacauguacaaauacggaaagauagcauucgucgcaauggaacgcauaacaugggacuacgacggcauaggguccaacggcaagaaaguagaccaugacaaguuccuagacgacgcagaaaaacacuaccugcccaagaccuacaccuucgacaacggaaccuucauaauccgagcaggcgacaaaguaagcgaagagaaaauaaaacgccuauacugggccagucgagaagucaaaucacaauuccaccgagucguaggcaacgacaaggcacuagaagugggaaacgccgacgauguccuaacuaugaaaaucuucaacagcccggaagaauacaaauucaacaccaacaucaacggggucucaaccgacaacggcgggcuguacauagagccgcgcggcacguucuacacguacgagcgcacaccccaacaaagcaucuuuucgcuagaagaacuuuuccgacacgaauauacccacuacuuacaggcucgauaccucguagauggccuauggggccaaggcccauucuacgaaaagaacagacucaccugguucgacgaaggaaccgcagaguucuucgcaggaucgaccaggacgagcggcguccucccaaggaaauccauacuuggauaccucgcaaaagauaagguagaccaccgguacucacuuaaaaagacucucaacucaggauacgacgacuccgacuggauguucuacaacuacggcuuugccguggcucacuaucuguacgaaaaggacaugcccaccuucaucaagaugaacaaagccauccucaacaccgacguaaaaagcuacgacgaaauaaucaagaaacucucagacgacgcgaauaaaaacacagaauaccaaaaucacauacaagagcucgccgacaaauaccagggcgcggggauaccgcucgucucugacgacuaccucaaagaccacggguacaagaaagccagcgaggucuacagugaaaucagcaaagccgccucgcuaaccaacaccagcguaacggcggagaaaagccaguacuucaacaccuucacacuaagaggaaccuauaccggugagaccagcaaaggcgaguucaaggacugggacgaaauguccaagaaauuagacgggacccuagaaucgcuggccaaaaacuccuggaguggguauaagacccuuaccgcguacuucacaaacuacagagugaccagcgacaauaaaguccaguacgaugucguguuccacggcgugcuaacagacaaugcagacaucucaaacaacaaagccccaaucgccaaagucacgggacccagcacaggcgccguaggccgcaacaucgaauuuucagguaaggauucaaaagacgaagacggcaagaucgucagcuacgacugggacuucggagacggcgccaccagcagagggaaaaacucaguacacgcguacaagaaggccgggaccuacaacgucacccuaaaaguuacggaugacaaaggcgccacagccacggaauccuucaccauagaaaucaagaacgaggacacaacuacccccauaaccaaagagauggagccaaacgaugacauaaaagaagcuaacggcccaaucguggaaggcguuacugucaaaggggaccuaaacggcucagacgacgccgacaccuucuacuuugacguaaaagaagacggggacgucacaauagaacucccauacuccggaaguagcaacuucaccuggcuaguguacaaggaaggggaugaucaaaaccacauagcauccggcauagacaagaacaacucaaaaguugggaccuucaaaucgaccaaaggccggcacuacguauucaucuacaaacacgacuccgcaaguaauauaucauacagccuaaacauaaaggggcugggaaaugaaaaacuuaaggaaaaagaaaacaacgacaguagcgacaaagcaacagugauccccaacuucaauacaaccaugcaaggcucacuccucggagaugacucaagggacuacuacucauucgaagugaaggaagaaggcgaagucaacaucgaacucgacaagaaggacgaguucggcgucaccuggacccuccacccugaaucaaacauaaacgacaggaucaccuacggccaaguagacggaaacaaagugucaaacaagguaaaacucagaccggggaaauauuaccuacugguguacaaauauucuggaagcggaaacuacgaacuacgagucaacaaauag

SEQ ID NO: 5234 - RNA, 2946 nt, Artificial Sequence
  derived and/or modified CDS sequence (opt8) from Clostridium histolyticum__BAA34542.1__ColH(41-1021)
guccaaaacgaaaguaaaagauauaccguauccuaucucaaaacuuuaaacuauuacgaccuaguagaccuccugguaaagacugaaauagaaaaccugccagaccuauuccaauacagcuccgacgcuaaggaguucuacgggaacaaaacccgcauguccuucaucauggacgaaaucgggcgacgcgcaccacaguacaccgaaauagaccacaaagggauucccacucuagucgaggugguacgagccggauuuuaccuuggauuccacaacaaagaacucaacgaaauaaauaagcgaucauucaaagagcggguuaucccaagcauacuggcaauccaaaagaauccaaacuucaaacuuggcacagaaguccaggacaaaauagucuccgccaccgggcuccucgccgggaaugaaaccgcacccccagaagucgugaauaacuucacccccauucuccaggacuguauaaagaacaucgaccgcuacgcacucgacgaccuuaagucaaaagcgcucuuuaacguccucgcggcgccuacauacgacaucacagaauaccuucgcgcgaccaaggaaaagccagaaaacaccccaugguacggaaaaauagacggguucaucaacgaacuaaagaaacuagcgcuauacggcaaaaucaacgacaacaacagcuggaucauugacaacggcauauaucacauagcaccccugggaaaacuccacagcaauaacaagaucggcaucgaaacccuaaccgaaguaaugaaagucuacccguaccucuccaugcagcaucuccagagcgccgaccagauaaaacgacacuacgacucaaaagacgcagaagguaauaagaucccacuggacaaguucaaaaaggagggcaaagaaaaauacugcccuaaaacauacaccuucgacgacggaaagguaauaauuaaagccggagcacgaguagaagaagaaaaaguaaaacgccucuacugggccucaaaggaaguuaauucacaguucuuccgaguguacgguauagacaaaccacuggaggagggaaacccagaugacauacugacgaugguaauauacaacuccccggaagaauacaaacuaaauucaguacuguacggauacgacaccaacaaugggggaauguacaucgaaccagaaggcaccuucuucaccuacgagcgcgaagcccaggagucgacauauacccuagaagaacuguuucgccacgaguacacgcacuacuuacaagggcgcuacgccguccccgggcaguggggccgaaccaaacuguacgacaacgaccgccucaccugguacgaagaagggggagcagaacucuucgcaggaucgacccgcaccagcggaauacucccccgcaagaguauagucagcaacauccacaacaccaccaggaacaacagauacaaacuuucagacaccguucacagcaaguacggggccuccuucgaguuuuacaacuacgcaugcauguucauggauuauauguacaacaaagacaugggaauacuaaacaaacucaaugaccucgccaaaaacaacgacgucgacggcuacgacaacuacauccgagaccucagcagcaacuacgcccuaaacgacaaauaucaagaccacaugcaggagaggauagauaacuacgaaaaucucaccgugccauucguagccgacgacuaccucguacgucacgccuacaaaaaccccaacgaaaucuacagcgagaucucggaaguagcaaaacuaaaagaugcuaaaucagaggugaagaaaucccaauacuucucgaccuucacucuccgcggcuccuacacaggaggagccagcaaagguaaacuagaggaccaaaaagcaaugaacaaauucaucgacgacucccucaagaaacucgauaccuacagcuggagcggauacaaaacguuaaccgcauauuucaccaauuacaaaguggacaguuccaaccgaguaaccuacgauguaguguuccauggcuaccuacccaacgagggcgacagcaaaaacucacuccccuacggaaagaucaacgggacauacaagggcacggaaaaagagaaaaucaaauucagcucagaaggcuccuucgaccccgacggcaagauugucuccuacgagugggacuucggggacggcaacaaaucgaacgaggagaacccagaacacagcuacgacaaggucggcacguacaccgucaagcucaaaguaacagacgacaagggggaauccagcguaagcacgacaacagcagaaaucaaggaccuauccgaaaauaaacuaccggugauauacaugcaugucccuaaauccggcgcucugaaucagaaggugguauucuacgggaagggcacguacgaccccgacggauccauagcaggcuaccaaugggacuucggcgaugguucggacuuuucguccgagcagaacccaagccacguauacacaaagaaaggggaguauaccgucacacuucgagucauggacagcaguggccagaugagugagaaaacaaugaaaaucaaaaucacagaucccguuuacccgaucggcacagaaaaagaaccaaacaauuccaaagagacggcgucaggcccaaucgugcccggaauccccguuucgggaaccauagagaacacaagcgaccaagacuacuucuacuucgacgucaucaccccaggcgagguaaaaauagacauaaacaaacuaggauacggaggcgcaacaugggugguauacgacgaaaacaacaacgcggucagcuaugcaacggacgacggccaaaaccuaucaggaaaguucaaggccgacaagcccggaagguacuauauacauuuguacauguucaacggcagcuacaugcccuacagaaucaacaucgaaggcagcgucggccgcuga

SEQ ID NO: 5235 - RNA, 3084 nt, Artificial Sequence
  derived and/or modified CDS sequence (opt8) from Clostridium histolyticum__BAA34542.1__ColH(1-40)_CS-F_ColH(41-1021)
augaaacgcaaaugccucagcaaacgacucaugcuagcuaucaccauggccacaauauucaccguaaacuccacccuacccaucuacgcggcaguggacaaaaacaacgccaccgccgcacgucgccgccggaaacgcguccaaaacgaaaguaagcgcuauacggugagcuaccucaaaacucucaacuacuaugaucuaguagaccuccuagucaaaacggaaauugaaaaccuccccgaccuauuccaguacucaucagacgcgaaagaguucuacggcaacaaaacccggauguccuucauaauggacgaaaucggaaggcgagcaccccaguauaccgagaucgaccacaagggcauccccacgcucguagaaguaguuagagcaggcuucuaccucggguuccacaacaaagaacuaaaugagaucaacaaacgcuccuucaaagaacgcgucauccccucaauacuagcaauccagaaaaaccccaauuucaaacuaggcaccgagguacaagauaaaaucguguccgcaacaggccuccuggcagguaaugaaaccgcgccgccagaaguagucaacaacuucacacccauccuucaggacugcaucaaaaacauagacagauacgcacucgacgaccucaaaagcaaagcacuauucaacguccucgcagcacccacauaugacauaacggaauaccuuagagcaaccaaagaaaaacccgaaaacacacccugguaugggaaaauagacggcuucaucaacgagcuuaaaaagcuggcacuuuacgggaaaauaaacgacaacaacagcuggaucauagacaacggcauuuaccacaucgcaccccuggggaaauugcacagcaacaacaaaaucggcauagaaacccucacggaggucaugaaaguuuacccauaccugucaaugcaacaccuccaauccgccgaccagaucaaacgacacuacgacagcaaagacgccgaaggcaacaagauaccacuagacaaguucaagaaagaaggcaaagaaaaauauugcccuaaaaccuacacauucgacgacggaaaaguaaucauuaaagccggcgcccguguagaagaagaaaaggucaaacgccuauacugggccagcaaagaaguaaauagccaauucuuccgcguauacgggauagacaaaccgcuagaagaaggaaaccccgacgacauacugaccaugguaauauauaacucaccggaagaauacaaacucaacagcguacuauacggcuaugacaccaauaacggaggaauguacaucgagccagaaggaacauucuucacguacgaacgugaagcacaagaauccacauacacccucgaggaacucuuccgucacgaguacacccacuaccuacaggggcgauacgccguacccggccaauggggccgcaccaaacuguaugacaacgaccggcucaccugguacgaagaagggggcgccgaacucuucgccgguucgaccaggacuucaggaauacugccccgcaagagcaucguaagcaacauccacaauacaacccgcaacaaccgcuacaaacuaucagacacaguccacuccaaauacggagcgucauuugaguucuacaacuacgcuugcauguuuauggauuauauguacaacaaagauauggggauccugaauaaacuaaacgaccuagcgaaaaacaacgacguugacggcuacgacaacuacauacgugaccucucaucaaacuacgcccuaaacgacaaauaccaggaccacaugcaagaacgcaucgacaauuacgaaaaccuaacagugccuuuugucgccgacgacuaccucguacggcacgcuuacaaaaaccccaacgaaaucuauucagaaaucucagaagucgccaaauuaaaagacgcuaaauccgaagucaagaagucccaauacuucuccacauuuacccucagaggcucauacaccggaggcgcauccaaaggcaaacuggaggaccaaaaagccaugaacaaauucaucgaugacagucuaaagaaacucgacaccuacuccugguccggauacaaaacgcuaacagccuacuucacaaacuacaaaguagacagcuccaaccgagucaccuacgacgucgucuuccaugguuaccuccccaacgaaggugacagcaaaaauucacuccccuacggcaaaauaaacggcaccuacaaaggcaccgaaaaggagaaaaucaaauucucaucggaaggcagcuucgacccagacgggaagauaguaucguaugaaugggacuucggggacggcaacaaauccaaugaagagaaccccgaacauuccuaugacaaaguggggaccuacacaguuaagcuaaaaguaaccgacgacaaaggcgaaucauccguaucaaccacaacggccgagauaaaagaucuaagcgaaaacaaacuccccguaauauacaugcacgucccuaaaucgggagcucucaaccaaaaagucguauucuacggaaaaggaacauacgacccugacggcuccauagccggcuaccaaugggacuuuggcgacggcagcgacuucuccagugagcaaaaccccucacacgucuacacgaaaaagggcgaauacaccgugacacuucgcguaauggacagcagcggccagauguccgagaaaaccaugaaaaucaagauuaccgacccagucuaccccauaggcaccgaaaaggaaccgaacaauagcaaggaaacagccagcggcccaauagucccggggauccccgucuccggcacgaucgaaaacacuuccgaccaggacuacuucuacuucgacguaauaacccccggcgaaguaaaaaucgacaucaacaaacuaggauacggaggcgccaccugggucgucuacgaugaaaacaacaacgccguauccuaugccacagacgauggccagaacuugucaggcaaguucaaagcugacaagcccggacgcuacuacauccaccuguacauguucaauggcuccuacaugccauaccgaauaaacaucgaaggaucggucggacgcuga

SEQ ID NO: 5236 - RNA, 3027 nt, Artificial Sequence
  derived and/or modified CDS sequence (opt9) from Clostridium histolyticum__BAA77453.1__ColG(111-1118)
aucgcaaacacaaacagcgaaaaauacgacuucgaauaccugaacggacucaguuacaccgaacucacaaaccucaucaagaacaucaaguggaaccaaauaaacggccucuucaacuacucgaccggcucccaaaaguucuucggggauaagaaccgcguccaagccauuaucaacgcccuccaagaaagcgggcgcacauacaccgccaacgacaugaagggcauagaaacauuuacagaagugcuacgcgcgggcuucuaccucggcuauuacaacgacggacucagcuaccuaaacgaccgaaacuuccaggacaagugcauaccggcaaugauagccauccagaaaaaucccaacuuuaaacucggaacugccgugcaagacgaaguaaucaccucgcucggaaaacuaaucggcaacgccucagccaaugccgaaguagucaauaacugcguccccgucuuaaagcaauuccgagagaacuugaaccaauacgcaccagacuacgucaagggcaccgccguaaacgaguuaaucaaagggauagaguucgacuucucgggagccgcauaugaaaaagacgucaaaaccaugccaugguacggcaaaaucgaccccuucauaaacgaacucaaagcccuuggccuauacggcaacauaacaagcgcgacagaaugggccagcgacguaggcaucuacuaccuaucaaaguucggacucuacagcaccaaccggaacgacauaguccaaagccucgaaaaagcaguagacauguacaaauacggcaaaauagccuucgucgcaauggagcgcauaacaugggauuacgacgggaucggcaguaaugguaagaaaguagaccaugacaaguuccucgacgacgcagaaaaacacuaccuaccuaagacauacaccuucgacaacggaaccuucauaauccgcgcaggcgacaaaguuagugaggagaaaaucaaaagacuauacugggcaucaagagaagucaaaucacaauuccaccgcguagucggcaacgacaaagcccucgaaguggggaacgccgacgacguccuaacaaugaaaaucuucaacagccccgaagaauacaaauucaauacuaauauaaacggaguaagcacagacaacggcggccuauauaucgaaccccgcgggacuuucuauaccuacgaaaggacgccgcaacaauccauauucucacuagaagaacuauuccgccacgaauacacccacuaccuccaggcaagauaccuagucgacggccuauggggucagggcccauucuacgaaaagaaccgccuaaccugguucgacgagggaacagccgaauuuuucgccggauccacccgcacaagcggaguccugccccgcaaaucaauacucggguaccuagcgaaagacaaaguggaccaccgauacagccuaaagaaaacacucaacuccggauacgaugacagcgacuggauguucuacaacuacggauucgccgucgcacacuaccuauacgagaaagacaugcccacuuucaucaaaaugaacaaagcgauacucaacaccgacgucaaaagcuacgacgagaucaucaagaaacuguccgacgacgcaaauaaaaacaccgaauaccagaaccacauucaggaacucgccgacaaauaccaaggagccggcaucccacucgucagcgacgacuaccucaaagaccacggguacaaaaaggcguccgaaguauauucugagaucagcaaagccgcaucccugaccaacacaucagucacagcagagaaaucucaguacuucaacacauucacgcuccgggggaccuacacaggcgaaacuagcaaaggggaguucaaggacugggacgagaugagcaagaaacuggauggcacacucgagagucucgcgaaaaacuccuggucgggcuacaaaacgcuuacagcauauuucaccaacuaccgcgucaccucagacaacaaaguccaauacgacgucguguuccacggagugcucaccgacaacgccgacaucuccaacaacaaggcaccuaucgcaaaggugaccggccccucaacaggcgcgguuggacggaacaucgaguucuccgggaaagacaguaaggacgaggacggcaaaauaguaagcuacgacugggacuucggagacggggcgaccucccgaggcaagaacagcguccacgccuacaagaaagccggcacauacaacgugacacuuaaaguuaccgacgacaaaggagccaccgccacggaguccuuuaccaucgagaucaaaaacgaagacaccacaaccccaauaaccaaagaaauggaaccuaacgacgacauuaaggaggcaaacggcccaauaguagaaggaguuacggucaagggugaccucaacgguuccgaugacgcagacaccuucuacuucgacgucaaagaagacggggauguaaccaucgaacuacccuacuccggauccucaaauuucacuuggcuaguauacaaggagggcgacgaccaaaaccacauagccucggggauagacaaaaacaacucuaaaguaggaaccuuuaaguccacaaagggacggcacuacgucuuuaucuacaagcacgacuccgcuuccaacauaucguacucguuaaacaucaaaggacuaggaaacgaaaaacucaaagagaaagaaaacaacgacucaucggacaaagcgacaguaauaccaaacuucaacaccacgaugcagggcucccuauugggagaugacagccgagacuacuacucguuugaaguaaaagaggaaggcgaagucaacaucgaacuagauaagaaagacgaguucggaguuacguggacccuccaccccgagagcaacaucaaugaccgaauuaccuauggccaggucgacgguaacaaaguaucuaauaaagucaaacuccgcccaggcaaauacuaccuccucgucuacaaguacagcgguagcggcaacuacgaacuacgcgugaauaaauaa

SEQ ID NO: 5237 - RNA, 3375 nt, Artificial Sequence
  derived and/or modified CDS sequence (opt9) from Clostridium histolyticum__BAA77453.1__ColG(1-110)_CS-F_ColG(111-1118)
augaaaaagaacauucucaaaauccucauggacagcuacagcaaagagagcaagauccagaccgugcgucgaguaaccagcgucagcuuacuagcgguauaccuaaccaugaacacauccagccuaguccuggcaaaacccaucgaaaacaccaaugacacuuccaucaagaacgucgagaagcuacgaaacgcaccaaacgaagagaauagcaagaaaguugaagauuccaaaaaugacaaaguagagcacgucaaaaacaucgaagaagcaaaagucgaacaaguagccccggaagucaaauccaagagcacgcuccgcuccgccaguagacggcgcaggaaacgcaucgcaaacacaaacuccgagaaauacgacuucgaauacuugaacggauuaagcuacacggagcuaaccaaccucaucaaaaauauaaaauggaaccaaauaaacggccuauucaacuauagcaccgggucccagaaauucuucggagauaagaaccgcguacaagcuaucaucaaugcccugcaggaauccggccgcacauacacggccaacgacaugaaagguauagaaacauucacagaagugcuaagggccggcuucuaccucggcuacuacaacgacgggcuaucauaccuaaaugacagaaauuuucaggacaaaugcauaccggcuaugaucgcgauacagaaaaacccgaacuucaagcuaggcacggccguacaagacgaagucaucaccuccuugggaaaacucauaggcaacgccuccgcgaacgccgaagucgucaacaacuguguacccguccuaaaacaguuuagagagaaccuaaaccaguacgcuccggacuacgucaaagggacagcagugaaugaacugauuaagggaauagaguucgacuucucaggcgcugccuacgaaaaggacgugaaaaccaugcccugguacggcaagaucgacccauucaucaacgaauuaaaagcacucggccuauauggcaacauaaccuccgccaccgaaugggcaucggacgucggaauauacuaccucaguaaauuuggacuguauagcaccaacagaaacgacaucguccaaagccucgagaaagcagucgacauguacaaauacggcaaaauagccuucguggcaauggaaaggaucacaugggacuacgacggcaucggguccaacggaaagaaaguagaccacgacaaauuucuugacgacgccgagaaacacuaccuaccaaaaacuuacaccuucgacaacggcaccuucauaaucagagcaggagacaaagucagcgaagagaaaaucaaacggcuuuacugggccucacgugaagugaaaagccaguuccaccgcgucgugggaaaugacaaggcauuggaaguagggaacgcggacgacguccuaacaaugaaaauauucaacagcccagaagaauacaaauucaacacuaacauaaauggagucuccaccgacaacggcggccucuacauagaaccaaggggcaccuuuuacacauacgaacgcacaccucagcaaagcauauuuucacuagaagaacucuuccgucacgaauacacccacuaccuccaggcuagauaccucguugacggacuguggggccagggccccuuuuaugagaaaaaccgccucacgugguucgacgaaggcacagccgaguucuucgccggcagcacacgaaccagcggcguacuaccacgaaaaucgauccucggcuaccuggcaaaagacaaagucgaucauagguacagccucaaaaagacacuaaacagcggauaugacgacucugacuggauguuuuacaacuacggguucgccgucgcacacuaccucuacgaaaaggacaugcccacauucaucaaaaugaacaaggcgauccuaaacacugacguaaaaagcuacgacgaaauaauaaagaagcuaagcgacgaugccaacaagaacacagaguaccaaaaccacauucaggaacuugccgacaaauaccagggagccggaaucccgcucguauccgacgacuaccuaaaagaccacggauacaaaaaggcauccgaagucuacagcgaaauaagcaaggccgcgucacuaacaaacacgucagucaccgcagagaaaucccaauacuucaacaccuuuacacugagagggacauacaccggcgaaaccucaaaaggagaguucaaagacugggacgaaauguccaagaaacuagacggaacacucgaaucgcuagcuaaaaacuccuggagcggauacaaaacccucacggcuuauuucaccaacuaccgcgucacgagcgacaacaagguacaauaugacguugucuuccacggcguccucacggacaacgccgacaucucaaacaauaaggcccccauagcaaaaguaacaggaccauccaccggcgcagucggccgaaacauagaguucucaggcaaagauuccaaagacgaagacgggaaaaucguuaguuacgauugggacuucggcgacggcgccaccucgcgagguaagaacuccgugcacgcauacaaaaaggccggaaccuacaacguuacccuaaaggugacagacgacaaaggagcgacggcgacagaaucuuucacaaucgaaaucaaaaacgaagacacuacaacacccaucacgaaagaaauggagcccaacgacgacaucaaggaagcaaacgggccgaucguugaaggaguaaccgucaaaggagaccucaacgggagcgacgacgcagacaccuucuacuucgaugucaaagaggacggggacguaacaaucgagcuccccuacucaggaagcagcaacuucacauggcuaguguacaaggagggcgacgaccagaaccacauagcguccggcaucgacaaaaacaacucaaaaguaggcaccuucaaaaguaccaaaggccgccacuacguuuucaucuacaagcacgacuccgccuccaacauaagcuacucgcuaaacaucaagggcuuaggcaacgaaaaacugaaagaaaaagaaaacaacgacucaucugacaaggccaccguaauacccaauuucaacacaaccaugcagggcucacugcucggagacgacucacgagauuacuacuccuuugaaguaaaagaagaaggcgaaguaaacaucgaauuggauaagaaagacgaguucggcgugacguggacacuucacccagaaucaaacaucaacgacaggauaaccuaugggcaaguagacggcaacaaaguaucuaacaaggucaagcuccgccccggcaaguacuaccugcucgucuacaaauacagcggaucuggaaacuaugaacuccgcguaaacaaauaa

SEQ ID NO: 5238 - RNA, 2946 nt, Artificial Sequence
  derived and/or modified CDS sequence (opt9) from Clostridium histolyticum__BAA34542.1__ColH(41-1021)
guacaaaacgagucgaaaagauacaccguaucauaccucaagacccucaacuacuacgaucucgucgaucuauuagucaagacagaaaucgaaaaucuacccgaccuauuccaguacucaucggacgccaaagaguucuacggcaacaaaacacgaaugagcuucauuauggacgaaauagguagacgagcgccgcaguacacggaaaucgaccacaaagggauccccaccuuagucgaaguuguacgcgcgggcuucuaccuaggauuucacaacaaagaacuuaacgaaaucaacaaacgcaguuucaaagaacgcgucauccccagcauccuagcgauccagaaaaaccccaauuuuaaacucggcaccgaaguacaggacaagauagugucagcaacaggccugcucgccggaaacgaaacggccccacccgaaguagucaauaacuucacacccauacugcaggacugcaucaaaaauaucgaccgauacgcacucgacgaccucaagagcaaagcccucuucaacgugcucgccgccccaaccuacgacauaaccgaauacuugagggccacaaaagaaaaacccgaaaacaccccaugguacggcaaaauugacggauucaucaacgagcugaagaaacucgcccucuacgggaaaaucaaugacaacaacagcuggaucaucgacaacggcaucuaccacauugccccgcuaggcaaacuacacuccaacaacaaaaucggcaucgaaacgcucacggaagucaugaaaguauauccauaucuauccaugcaacaccuccaaucugccgaccaaaucaaacgccacuacgacagcaaggacgcggaaggaaacaaaaucccacucgacaaguuuaagaaggaaggcaaagaaaaauacugcccuaaaaccuacacguucgaugacgggaaaguaauuaucaaagccggcgcccgagucgaagaggaaaaggugaaacgccuauacugggccuccaaagagguuaauucacaauuuuuccgagucuauggcaucgacaaaccacucgaggaagguaaccccgacgauauccucaccaugguaauauauaauucgcccgaggaauauaaacucaacagcgucuuauacggcuacgacaccaacaacgguggcauguacaucgagccggaaggcaccuucuucaccuacgagcgugaagcccaagaauccacguacacacuugaggaacuauuccgacaugaauacacccacuaccugcaaggccgguacgcaguaccuggccaguggggccgcacuaaacucuacgacaacgaccgucucaccugguacgaagaagguggagccgaacucuucgccggcuccacccgcaccagcggcauccuaccccgaaaauccauagucucgaacauucacaacacaacccgaaauaaccgcuacaaacucagcgacaccguacacucaaaauacggagccagcuucgaguucuacaacuacgcgugcauguucauggacuacauguacaacaaagauauggggauucuaaacaaacuuaacgaccucgccaaaaauaacgacgucgacgguuacgacaacuauauacgagaucuuucaucgaacuacgcacuaaacgacaaauaccaggaccacaugcaagaacgcaucgacaacuacgaaaaccucaccguccccuucgucgcagacgauuaccucguccgacacgcauacaagaaccccaacgaaauauacucggagaucagcgaagucgccaagcucaaagaugcaaaauccgaagucaaaaagucacaguacuuuagcacauucacacuccgcgggagcuacaccggcggcgcguccaagggaaagcucgaagaccaaaaagccaugaacaaauuuauagacgacucccucaagaaacucgacaccuacucguggagcggcuacaaaacacuuaccgcauacuucaccaacuacaaaguagacagcucaaaucggguaacuuacgacguagucuuccacggcuaccuucccaaugaaggagacagcaagaacucacucccuuacggcaaaauaaauggaacguacaagggcacggaaaaggagaaaaucaaauucagcuccgaaggcuccuucgaccccgacggaaaaauaguaucauacgaaugggacuucggcgacggcaacaagaguaacgaagaaaaucccgaacacucauacgacaaagucggcacguacaccgucaaacuaaaaguaacagacgacaaaggcgaauccucagugaguacgaccaccgcagaaaucaaagacuuaucagaaaacaaacuccccguaauauacaugcacgucccaaagagcggggcacucaaccaaaaagucgucuucuacggcaaaggaaccuacgacccugacggauccaucgccggcuaccagugggauuucggcgacggaagcgacuucucaucggagcaaaacccaagccacgucuacacgaaaaagggagaauacacagugacacuccgaguaauggacuccucagggcagauguccgagaaaaccaugaaaauaaagaucaccgacccugucuaccccaucggaaccgaaaaggagccuaacaauuccaaagaaaccgccagcggaccaauaguacccgguauccccgucuccggaaccaucgaaaacacgucagaccaggacuacuucuacuucgacgucauaaccccgggcgaaguaaaaaucgacaucaacaaacuaggcuacggcggagccacaugggucguauacgacgaaaacaacaacgcgguaucuuacgcaacagacgacggccaaaaccuaagcggcaaguucaaagcagacaaacccgggcgcuacuacauccaccuguacauguucaacggaagcuacaugccauacagaauaaauaucgaaggcuccguaggacguuaa

SEQ ID NO: 5239 - RNA, 3084 nt, Artificial Sequence
  derived and/or modified CDS sequence (opt9) from Clostridium histolyticum__BAA34542.1__ColH(1-40)_CS-F_ColH(41-1021)
augaaacggaaaugucuauccaaacgccugaugcuggccauuacgauggccaccaucuucaccgucaacucuacccugccgaucuacgccgccguagacaagaacaacgccaccgccgcucgccgccgaagaaagaggguccaaaacgaaagcaaaagauacacaguaagcuaccuuaagacacucaacuacuacgaccucguagaccuacucgucaagacagaaauugagaaccuccccgaccuauuccaauacagcagcgacgccaaagaguucuacggcaacaaaacccgaaugucuuucauaauggaugaaauaggacgcagagcgccccaauacacggaaaucgaucacaaaggcauacccacccuaguggaagucguacgagcuggcuucuaucuggguuuccacaacaaagaacugaacgaaauaaacaagcgcagcuucaaagaacgcgugauccccucaauacuggcuauccagaaaaaucccaauuucaaacuagggaccgaaguccaagacaagaucguguccgcgacaggacuccucgccggcaacgaaaccgccccgccggaagucguuaacaacuucacgccaauacuacaagacugcauuaaaaacaucgaccgauacgcccuagacgaucugaaauccaaggcacuauucaacguucuggccgcaccaacauacgacaucacagaguaccugcgugccacaaaagaaaaaccagaaaauacccccugguacggcaaaaucgacggauucauuaaugaguugaaaaagcuagcacucuacggaaaaaucaacgacaauaacagcuggaucaucgacaacggcauuuaccacauagcgccccucggcaaacugcacuccaacaacaaaaucgguauagagacacucacagaggugaugaaaguuuacccauaccuaagcaugcaacaccuucaauccgccgaccaaaucaaacgccacuacgacuccaaagacgcggaaggcaacaaaauaccccucgacaaauuuaaaaaggagggcaaagaaaaauacugcccaaagaccuacaccuucgaugacggcaaaguaauaaucaaagcaggagccagagucgaggaggagaaggucaaaaggcuauacugggcaucuaaggaagugaacagccaauucuuucggguauacggaaucgacaagccccuagaagaagguaaccccgacgacauccuuacaaugguaauauacaacagcccggaagaguacaaacucaacaguguucuauacggauacgauacgaacaacggaggcauguacaucgaaccggagggcaccuucuucaccuacgagcgagaggcccaagaaagcacauacaccuuagaagaacuguuccgacacgaauacacccauuaccuccaaggcagauacgcuguccccggccaauggggacgcacuaaacuauacgauaacgaccgccuaacaugguacgaagaggguggcgccgaacucuucgccggcucaacgagaacgagcggaauccugccgcgcaaaagcaucgucagcaacauacacaacacaacgcgaaacaaucguuacaaacucucggacacgguccacucaaaauacggcgcgucauucgaguucuacaacuacgccugcauguucauggauuacauguacaauaaggacaugggcauccuaaacaaacucaacgaccucgcuaaaaacaacgacgucgacggcuacgacaacuauauccgagaccuaagcucgaacuacgcacucaaugacaaauaccaagaccacaugcaagagcgcaucgacaacuacgaaaaccuaacaguacccuucguugcggacgacuaucucgucaggcacgcauacaagaacccaaacgagauauacagcgaaaucagcgagguagccaaacuuaaggacgccaaauccgaagucaagaaaucgcaguacuucucaaccuucacgcuacguggcagcuacaccgggggagcaagcaaaggaaaacucgaggaccaaaaagcaaugaacaaguuuauugacgacagccuaaagaaacuagauacauauuccugguccggcuacaaaacgcuaacggcauacuucacgaacuacaagguugacucaaguaaccgcguaacauacgacguaguuuuccacggauaccuaccaaaugaaggcgacuccaaaaacucgcugccauacggaaaaaucaauggcacauacaaagggacagagaaggagaaaaucaaauucaguucagaaggauccuucgacccagacggcaaaaucguuucauaugaaugggauuucggagacgggaacaaaucaaacgaagaaaacccugagcacagcuacgacaaagucggcacauauacaguaaagcucaaagucacggacgacaagggcgagagcagcguaagcacgaccaccgcagaaaucaaggaccucuccgaaaauaaacucccagucauauacaugcacguaccaaaaucgggcgcccucaaccagaaaguaguguucuacggaaaaggcacauacgauccggacggauccauagcaggcuaccaaugggauuucggagaugggagcgacuucucgagcgaacaaaacccgucacacgucuacacuaaaaagggcgaguacaccguaacccuucggguaauggacuccuccggacaaaugucugagaaaaccaugaaaaucaagauaaccgacccaguauaccccaucggcaccgaaaaagaaccaaacaacuccaaagaaacugccuccggccccaucguaccgggaaucccagucuccggcaccaucgaaaacaccagcgaccaagauuacuucuacuucgacguaaucacccccggagaagucaaaaucgacaucaacaaacugggcuacggaggagcuaccuggguagucuacgacgaaaacaacaacgccgucaguuacgccaccgacgacgggcaaaaccuguccgguaaauuuaaggccgacaagccagggcgauacuacauccaccuguauauguuuaacggauccuauaugcccuaccgaauaaauaucgaaggaaguguaggccgcuaa

SEQ ID NO: 5240 - RNA, 3027 nt, Artificial Sequence
  derived and/or modified CDS sequence (opt11) from Clostridium histolyticum__BAA77453.1__ColG(111-1118)
aucgccaacaccaacagcgagaaguacgacuucgaguaccugaacggccucucuuacacggagcugaccaaucugaucaagaacaucaaguggaaccagauuaacggguuauucaacuacagcaccggcucccagaaguucuucggggacaaaaaccgcguccaggcgauuaucaacgcccugcaggagagcggucggaccuacaccgcuaacgacaugaaggggaucgagaccuucaccgagguucugcgcgccggcuucuaccucggcuacuacaacgacgggcuguccuaccugaacgaccggaacuuccaggacaagugcauccccgccaugaucgcgauccagaagaacccgaacuucaagcucggcaccgccgugcaggacgaggucaucacgagccuggggaagcugaucggcaacgccuccgccaacgcggagguggugaacaacugcguccccgugcucaagcaauuccgcgaaaaccugaaccaguacgcccccgacuacguaaaggggaccgccgucaacgagcugaucaagggcaucgaguucgacuuuagcggcgccgccuacgagaaagacgugaagaccaugcccugguacgggaagaucgacccguucaucaacgagcucaaggcgcugggccuguacgggaacaucaccuccgccacggagugggccagcgacgugggcaucuacuaccucuccaaguucggccuguacucgaccaaccggaaugacaucguacagucccuggagaaggccguggacauguacaaguacgggaagaucgccuucguggcgauggagcgcaucaccugggacuacgacgguaucgggagcaacggcaagaaggucgaccacgacaaauuccucgacgacgccgagaagcacuaccugcccaagaccuacacguucgacaacggcaccuucaucauccgggccggugacaagguguccgaggagaagaucaagcgccuguacugggccagccgagaggucaagagccaguuccaccgcguggugggcaacgacaaggcccucgagguggggaacgcggacgacguccugaccaugaagaucuucaacuccccugaggaguacaaguucaacaccaacaucaacggcguguccacggauaacgggggccuguacaucgagccccgggggaccuucuacaccuaugagcgcaccccgcagcaguccaucuucagccucgaggagcuguuucggcacgaguacacgcacuaccugcaggcccgcuacuuaguggacggccuguggggccaggggcccuucuacgagaagaaccggcugaccugguucgacgagggcaccgccgaguucuucgccgguuccacccgcacgagcggcguccucccccgaaaguccauccugggguaccuggccaaggacaagguggaccaccgcuacagccucaagaagacccugaacuccggcuacgacgacucggacuggauguucuacaacuacggcuucgcggucgcccacuaccuguacgagaaggacaugcccaccuucaucaagaugaacaaggccauccucaacaccgacgugaaguccuacgacgagaucaucaagaagcugagcgacgacgccaacaagaacacggaguaccagaaccacauccaggagcuggcggacaaauaccagggugccggcaucccucucguguccgacgacuaccugaaggaccacggguacaagaaggccagcgaggucuacuccgagauuagcaaggccgccucccugaccaacaccagcgugaccgcggagaagucccaguacuucaacacguucacccuccggggcaccuacaccggcgaaaccagcaagggggaguucaaggacugggacgagaugagcaagaagcuggacggcacgcuggaaucccuggccaagaacagcugguccggguacaagacccucaccgccuauuuuaccaacuaccgcgugacgagcgacaacaagguccaguacgacgugguguuccacggcguccugaccgacaacgccgacaucuccaacaacaaggcccccaucgcgaaggugaccgggcccagcaccggcgccgugggccggaacaucgaguucuccgggaaggacucuaaggacgaggacggcaagauagucuccuacgacugggacuucggggacggcgccacgucccgcgggaagaacuccguccacgccuacaagaaggccggcaccuacaacgugacccugaaggucaccgacgacaaaggcgcgacggccaccgagagcuucaccaucgagaucaagaacgaggacaccacgacccccaucaccaaggagauggagccgaacgacgacaucaaggaggccaacgggcccaucguggagggcgugaccgucaagggggaccucaacggcuccgacgacgcagacacguucuacuucgaugugaaggaggacggggacgugaccaucgagcugcccuacagcggcuccagcaacuucaccuggcuggucuacaaggagggcgacgaccagaaccacaucgcguccgggaucgacaagaacaacagcaaggugggcaccuucaagagcacgaaggggcgccacuacguguucaucuacaagcacgacuccgccagcaacaucuccuacagccucaacaucaagggccuggggaacgagaagcugaaggagaaggagaacaacgacuccagcgacaaggccaccgucauccccaacuucaacaccaccaugcagggcucccuccugggcgacgacagccgggacuacuacuccuucgaggugaaggaggagggggaggugaacaucgagcuggacaagaaggacgaguucggcgucacguggacccuccacccggaauccaacauaaacgaccgcaucaccuacggccagguggacgggaacaagguguccaacaaggucaagcugcggcccggcaaguacuaccugcucguguacaaguacagcggguccggaaacuacgagcugcgcgugaacaaguga

SEQ ID NO: 5241 - RNA, 3375 nt, Artificial Sequence
  derived and/or modified CDS sequence (opt11) from Clostridium histolyticum__BAA77453.1__ColG(1-110)_CS-F_ColG(111-1118)
augaagaagaacauccugaagauccucauggacagcuacuccaaggagagcaagauccagaccguccgccgggugacguccgugagccugcuggccgucuaccucaccaugaacaccuccagccuggugcuggcgaagcccaucgagaacaccaacgacacguccaucaagaacguggagaagcuccgcaacgccccgaacgaggagaacagcaagaaggucgaggacuccaagaacgacaagguggagcacgugaagaacaucgaggaggccaaggucgagcaggucgcccccgaggucaagagcaaguccacccugcggagcgccucccgccggcgccggaagcgcaucgcgaacaccaacagcgagaaguacgacuucgaguaccugaacggccucuccuacaccgagcugacgaaccugaucaagaacaucaaguggaaccagaucaacgggcuguucaacuacagcaccggcagccagaaguucuucggggacaagaaccgggugcaggccaucaucaacgcccugcaggaguccggccgcaccuacaccgccaacgacaugaaggggaucgagacguucaccgaggugcugcgggcgggcuucuaccucggcuacuacaacgacgggcugagcuaccugaacgaccgcaacuuccaggacaagugcauccccgccaugaucgccauccagaagaaccccaacuucaagcucggcaccgccgugcaggacgaggugaucaccucccuggggaagcugaucggcaacgccagcgcgaacgccgagguggugaacaacugcgucccggugcucaagcaguuccgggagaaccugaaccaguacgcccccgacuacgugaaggggacggccgucaacgagcugaucaagggcaucgaguucgacuucuccggcgccgcguacgagaaggacgugaagaccaugcccugguacgggaagaucgaccccuucaucaacgagcucaaggcccugggccuguacgggaacaucaccagcgccaccgagugggccuccgacgugggcaucuacuaccucagcaaguucggccuguacuccacgaaccgcaacgacaucguccagagccuggagaaggccguggacauguacaaguacgggaagaucgcguucgucgccauggagcggaucaccugggacuacgacggcaucggguccaacggcaagaagguggaccacgacaaguuccucgacgacgccgagaagcacuaccugccgaagaccuacaccuucgacaacgggacguucaucauccgcgccggcgacaaggugagcgaggagaagaucaagcggcuguacugggccucccgcgaggucaagagccaguuccaccggguggugggcaacgacaaggcgcucgaggucgggaacgccgacgacgugcugaccaugaagaucuucaacucccccgaggaguacaaguucaacaccaacaucaacggcgugagcaccgacaacgggggccuguacaucgagccccgcgggacguucuacaccuacgagcggacgccccagcaguccaucuucagccucgaggagcuguuccgccacgaguacacccacuaccugcaggcccgcuaccucgucgacggccuguggggccaggggccguucuacgagaagaaccggcugaccugguucgacgagggcaccgccgaguucuucgcgggguccacccgcaccagcggcgugcucccccgcaagagcauccugggguaccuggccaaggacaagguggaccaccgguacucccucaagaagacgcugaacagcggcuacgacgacuccgacuggauguucuacaacuacggcuucgccgucgcccacuaccuguacgagaaggacaugcccaccuucaucaagaugaacaaggccauccugaacaccgacgucaagagcuacgacgagaucaucaagaagcucuccgacgacgcgaacaagaacaccgaguaccagaaccacauccaggagcuggccgacaaguaccagggggccggcaucccccuggugagcgacgacuaccucaaggaccacggguacaagaaggccuccgagguguacagcgagaucuccaaggccgcgagccugaccaacacguccgugaccgccgagaagucccaguacuucaacaccuucacccugcggggcacguacaccggcgagaccagcaagggggaguucaaggacugggacgagaugagcaagaagcucgacggcacccuggagucccuggccaagaacagcugguccggguacaagacgcucaccgccuacuucaccaacuaccgcgugaccagcgacaacaagguccaguacgacgugguguuccacggcguccugacggacaacgccgacaucagcaacaacaaggcgccgaucgccaaggugaccgggcccuccaccggcgccgugggccggaacaucgaguucagcgggaaggacuccaaggacgaggacggcaagaucgucagcuacgacugggacuucggggacggcgccaccucccgcgggaagaacagcgugcacgcguacaagaaggccggcacguacaacgugacccugaaggucaccgacgacaagggcgccaccgccacggaguccuucaccaucgagaucaagaacgaggacaccaccacgcccaucaccaaggagauggagcccaacgacgacaucaaggaggccaacgggccgaucguggagggcgugaccgucaagggggaccucaacggcagcgacgacgcggacaccuucuacuucgacgugaaggaggacggggacgugacgaucgagcugcccuacuccggcagcuccaacuucaccuggcuggucuacaaggagggcgacgaccagaaccacaucgccagcgggaucgacaagaacaacuccaaggugggcaccuucaagagcaccaaggggcggcacuacguguucaucuacaagcacgacuccgccagcaacaucuccuacagccucaacaucaagggccuggggaacgagaagcugaaggagaaggagaacaacgacuccagcgacaaggccacggucauccccaacuucaacaccaccaugcagggcagccuccugggcgacgacucccgcgacuacuacagcuucgaggugaaggaggagggggaggugaacaucgagcuggacaagaaggacgaguucggcgucaccuggacgcuccaccccgaguccaacaucaacgaccggaucaccuacggccagguggacgggaacaaggugagcaacaaggucaagcugcgcccgggcaaguacuaccugcucguguacaaguacuccgggagcggcaacuacgagcugcgggugaacaaguga

SEQ ID NO: 5242 - RNA, 2946 nt, Artificial Sequence
  derived and/or modified CDS sequence (opt11) from Clostridium histolyticum__BAA34542.1__ColH(41-1021)
guccagaacgagagcaagcgcuacaccguguccuaccugaagacgcucaacuacuacgaccugguggaccugcucgucaagaccgagaucgagaaccugcccgaccuguuccaguacagcuccgacgccaaggaguucuacggcaacaagacccggaugagcuucaucauggacgagaucgggcgccgggcgccgcaguacaccgagaucgaccacaagggcauccccacgcucguggaggugguccgcgccggguucuaccugggcuuccacaacaaggagcugaacgagaucaacaagcgguccuucaaggagcgcgugauccccagcauccucgccauccagaagaaccccaacuucaagcuggggaccgaggugcaggacaagaucgucuccgccaccggccugcucgccggcaacgagaccgcgccgcccgagguggugaacaacuucacgcccauccugcaggacugcaucaagaacaucgaccgguacgcccuggacgaccucaagagcaaggcccuguucaacguccuggccgcgcccaccuacgacaucaccgaguaccuccgcgccaccaaggagaagccggagaacacgcccugguacgggaagaucgacggcuucaucaacgagcugaagaagcuggcccucuacgggaagaucaacgacaacaacuccuggaucaucgacaacggcaucuaccacaucgcgccccuggggaagcugcacagcaacaacaagaucggcaucgagacccucaccgaggugaugaagguguaccccuaccuguccaugcagcaccuccagagcgccgaccagaucaagcggcacuacgacuccaaggacgccgagggcaacaagaucccgcucgacaaguucaagaaggaggggaaggagaaguacugccccaagaccuacacguucgacgacggcaaggucaucaucaaggccggggcccgcguggaggaggagaaggugaagcggcuguacugggccagcaaggaggucaacucccaguucuuccgcguguacggcaucgacaagccccuggaggagggcaaccccgacgacauccucaccauggugaucuacaacagcccggaggaguacaagcugaacagcguccuguacggguacgacaccaacaacggcgggauguacaucgagcccgagggcaccuucuucacguacgagcgggaggcccaggaguccaccuacacccucgaggagcuguuccgccacgaguacacccacuaccugcaggggcgguacgcggugcccggccaguggggccgcacgaagcucuacgacaacgaccggcugaccugguacgaggagggcggggccgagcuguucgccgggagcacccgcaccuccggcauccucccccgcaagagcaucguguccaacauccacaacacgacccggaacaaccgguacaagcugagcgacaccguccacuccaaguacggggccagcuucgaguucuacaacuacgccugcauguucauggacuacauguacaacaaggacaugggcauccugaacaagcucaacgaccuggcgaagaacaacgacguggacggcuacgacaacuacauccgcgaccuguccagcaacuacgcccucaacgacaaguaccaggaccacaugcaggagcgcaucgacaacuacgagaaccugaccgucccguucguggccgacgacuaccuggugcggcacgccuacaagaaccccaacgagaucuacuccgagaucagcgaggucgccaagcugaaggacgcgaaguccgaggugaagaagucccaguacuucagcacguucacccuccgcgggagcuacaccggcggggccuccaagggcaagcuggaggaccagaaggccaugaacaaguucaucgacgacagccugaagaagcucgacaccuacuccuggagcggguacaagacgcugaccgccuacuucaccaacuacaagguggacagcuccaaccgggucaccuacgacgugguguuccacggcuaccugcccaacgagggcgacagcaagaacucccuccccuacgggaagaucaacggcaccuacaaggggacggagaaggagaagaucaaguucagcuccgagggcagcuucgacccggacggcaagaucgucuccuacgagugggacuucggggacggcaacaagagcaacgaggagaaccccgagcacuccuacgacaagguggggaccuacaccgugaagcugaaggucaccgacgacaagggcgagagcuccgugagcacgaccaccgcggagaucaaggaccuguccgagaacaagcuccccgugaucuacaugcacguccccaagagcggggcccugaaccagaaggugguguucuacggcaagggcaccuacgacccggacggguccaucgccggcuaccagugggacuucggggacggcagcgacuucuccagcgagcagaaccccagccacgucuacacgaagaagggggaguacaccgugacccugcgcgugauggacuccagcggccagauguccgagaagaccaugaagaucaagaucacggaccccgucuacccgaucggcaccgagaaggagcccaacaacagcaaggagaccgccuccgggcccaucgugcccggcaucccggugagcgggaccaucgagaacacguccgaccaggacuacuucuacuucgacgucaucacccccggcgaggugaagaucgacaucaacaagcucggguacggcggcgccaccuggguggucuacgacgagaacaacaacgcggugagcuacgccaccgacgacgggcagaaccuguccggcaaguucaaggccgacaagcccgggcgguacuacauccaccuguacauguucaacggcagcuacaugcccuaccgcaucaacaucgagggguccgugggccgguga
